United States Patent
Go et al.

(10) Patent No.: US 12,497,600 B2
(45) Date of Patent: Dec. 16, 2025

(54) BIOSYNTHESIS OF CANNABINOIDS FROM CANNABIGEROLIC ACID USING NOVEL CANNABINOID SYNTHASES

(71) Applicant: National University of Singapore, Singapore (SG)

(72) Inventors: Maybelle Darlene Kho Go, Singapore (SG); Wen Shan Yew, Singapore (SG)

(73) Assignee: National University of Singapore, Singapore (SG)

( * ) Notice: Subject to any disclaimer, the term of this patent is extended or adjusted under 35 U.S.C. 154(b) by 609 days.

(21) Appl. No.: 17/767,764

(22) PCT Filed: Oct. 12, 2020

(86) PCT No.: PCT/SG2020/050583
§ 371 (c)(1),
(2) Date: Apr. 8, 2022

(87) PCT Pub. No.: WO2021/071438
PCT Pub. Date: Apr. 15, 2021

(65) Prior Publication Data
US 2024/0084270 A1    Mar. 14, 2024

Related U.S. Application Data

(60) Provisional application No. 62/913,991, filed on Oct. 11, 2019.

(51) Int. Cl.
| | | |
|---|---|---|
| *C12N 9/02* | (2006.01) | |
| *C12N 15/81* | (2006.01) | |
| *C12P 17/04* | (2006.01) | |
| *C12P 17/06* | (2006.01) | |
| *C12P 17/16* | (2006.01) | |
| *C12R 1/84* | (2006.01) | |
| *C12R 1/865* | (2006.01) | |

(52) U.S. Cl.
CPC .......... *C12N 9/0004* (2013.01); *C12N 15/815* (2013.01); *C12P 17/04* (2013.01); *C12P 17/06* (2013.01); *C12P 17/162* (2013.01); *C12R 2001/84* (2021.05); *C12R 2001/865* (2021.05); *C12Y 121/03007* (2015.07)

(58) Field of Classification Search
CPC ..... C12N 9/0004; C12N 15/815; C12P 17/04; C12P 17/06; C12P 17/162; C12Y 121/03007; C12R 2001/84; C12R 2001/865
See application file for complete search history.

(56) References Cited

U.S. PATENT DOCUMENTS

| | | |
|---|---|---|
| 10,563,211 B2 | 2/2020 | Keasling et al. |
| 2014/0057251 A1 | 2/2014 | McKernan |
| 2019/0300888 A1 | 10/2019 | Keasling et al. |

FOREIGN PATENT DOCUMENTS

| | | | |
|---|---|---|---|
| CN | 105555265 A | 5/2016 | |
| WO | WO 2016189384 A1 | 12/2016 | |
| WO | WO 2017139496 A1 | 8/2017 | |
| WO | 2018148848 A1 | 8/2018 | |
| WO | WO-2019/046941 A1 | 3/2019 | |
| WO | WO-2019/190945 A1 | 10/2019 | |
| WO | WO-2019209721 A1 * | 10/2019 | ........... C07K 14/415 |
| WO | WO-2020/069214 A2 | 4/2020 | |

OTHER PUBLICATIONS

ElSohly and Gul, "Chapter 1 Constituents of Cannabis Sativa," International Review of Psychiatry. (Year: 2018).*
"Cannabielsoic acid A," PubChem, downloaded Mar. 6, 2025 from <https://pubchem.ncbi.nlm.nih.gov/compound/Cannabielsoic-acid-A >. (Year: 2004).*
"Cannabielsoin," PubChem, downloaded Mar. 6, 2025 from <https://pubchem.ncbi.nlm.nih.gov/compound/Cannabielsoin pound/Cannabielsoin>. (Year: 2004).*
Niranjan Aryal, et al. Distribution of Cannabinoid Synthase Genes in Non-Cannabis Organisms, Journal of Cannabis Research, Aug. 5, 2019, pp. 1-6, vol. 1, No. 1, BMC, Los Angeles CA, US.
Database UnitProt, RecName: Full=FAD-Binding PCMH-type domain-containing Protein, Bee, 1 page, XP093089451.
Bastian Zirpel, et al., Engineering Yeasts as Platform Organisms for Cannabinoid Biosynthesis, Journal of Biotechnology, Jul. 8, 2017, pp. 204-212, vol. 259.
Kerstin Lange, et al., [Delta] 9-Tetrahydrocannabinoid Acid Synthase Production in Pichia Pastoris Enables Chemical Synthesis of Cannabinoids, Journal of Biotechnology, Jul. 18, 2015, pp. 68-76, vol. 211, Elsevier, Amsterdam NL.
Maybelle K. Go, et al., Cannabinoid Biosynthesis Using Noncanonical Cannabinoid Synthases, Jan. 31, 2020, pp. 1-20.
M4DIE5_BRARP, BBE domain-containing protein, *Brassica rapa* Genome Sequencing Project Consortium, UniProt, 2 pages.

* cited by examiner

*Primary Examiner* — Suzanne M Noakes
*Assistant Examiner* — Ciara A Mcknight
(74) *Attorney, Agent, or Firm* — Cesari and McKenna, LLP

(57) ABSTRACT

A method for producing a cannabinoid by contacting cannabigerolic acid with a cannabinoid synthase orthologue. The cannabinoid synthase orthologue is from an organism other than *Cannabis sativa*. Also disclosed is a recombinant cell of *Saccharomyces cerevisiae* or *Pichia pastoris* that includes in its genome a nucleic acid encoding the above cannabinoid synthase orthologue. The cannabinoid synthase orthologue is expressed in the recombinant cell in an active form.

3 Claims, 7 Drawing Sheets
Specification includes a Sequence Listing.

BIOSYNTHESIS OF CANNABINOIDS FROM CANNABIGEROLIC ACID USING NOVEL CANNABINOID SYNTHASES

BACKGROUND

The cannabinoid biosynthetic pathway has been the subject of intense investigation. Cloning and expression of the various enzymes in the cannabinoid biosynthetic pathway has been accomplished by several research groups. For example, the structure and function of $\Delta^1$-tetrahydrocannabinolic acid synthase, i.e., a cannabinoid synthase, has been elucidated. See Shoyama et al., J. Mol. Biol. 2012, 423(1): 96-105.

The biosynthesis of two cannabinoids, cannabidiolic acid and $\Delta^9$-tetrahydrocannabinolic acid, has been accomplished by expressing cannabinoid biosynthetic pathway enzymes from *Cannabis sativa* and other organisms heterologously in *Saccharomyces cerevisiae*. See, e.g., Luo et al., Nature 2019, 567(7746):123-126 and Zirpel et al., J. Biotechnol. 2017, 259:204-212. Studies such as these have established that it is possible to build the cannabinoid biosynthetic pathway in a heterologous system.

Additional enzymes and methods are needed for synthesizing cannabinoids with specificity and high yield.

SUMMARY

A method is disclosed for producing a cannabinoid. The method includes the steps of contacting cannabigerolic acid with a cannabinoid synthase orthologue. The cannabinoid synthase orthologue is from an organism other than *Cannabis sativa*, e.g., *Citrus sinensis, Cucumis melo, Capsicum annuum, Brassica napus, Nicotiana attenuata, Nicotiana tabacum, Noccaea caerulescens* (*Thlaspi caerulescens*), *Gossypium hirsutum* (*Gossypium mexicanum*), *Oryza sativa* subsp. *indica*, *Oryza sativa* subsp. *japonica*, *Arabidopsis lyrata* subsp. *lyrata*, *Paenibacillus* sp. Aloe-11, *Streptomyces ipomoeae* 91-03, *Brassica rapa* subsp. *pekinensis*, *Prunus persica*, *Bacillus subtilis* 168, *Arabidopsis thaliana*, *Papaver somniferum* and *Phytophthora parasitica* P1569.

Also provided are recombinant cells of *Saccharomyces cerevisiae* and *Pichia pastoris* that each include in their genomes a nucleic acid encoding a cannabinoid synthase orthologue, wherein the cannabinoid synthase orthologue is from any of the organisms listed in the preceding paragraph, and the cannabinoid synthase orthologue is expressed in the recombinant cells in an active form.

The details of one or more embodiments are set forth in the description and the examples below. Other features, objects, and advantages will be apparent from the detailed description, from the drawings, and also from the appended claims.

BRIEF DESCRIPTION OF THE DRAWINGS

The invention description below refers to the accompanying drawings, of which.

DETAILED DESCRIPTION

Figure 1:
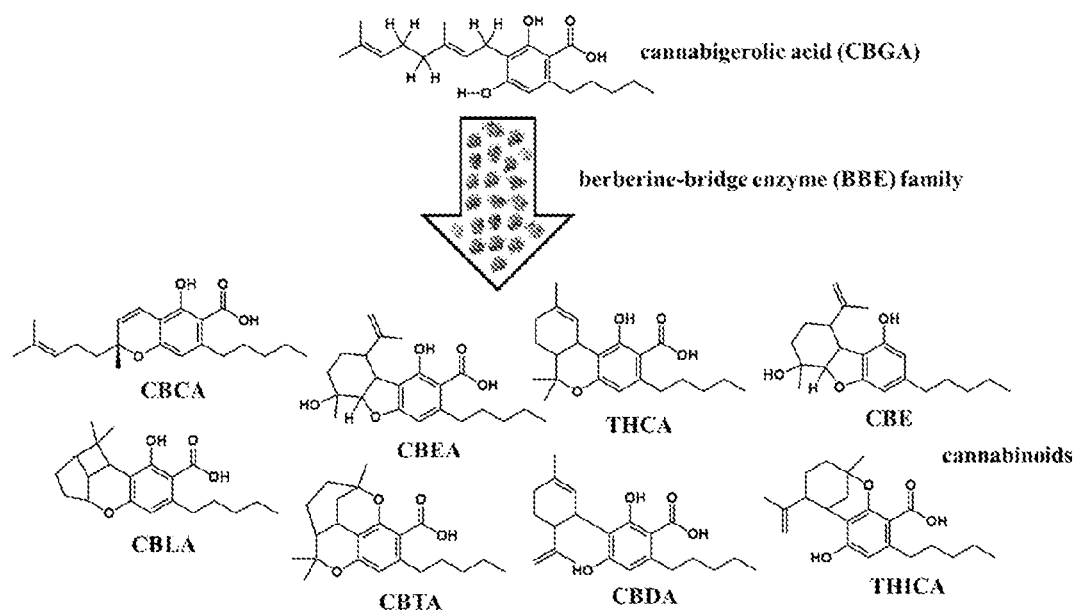
FIG. 1 shows cannabinoid products that can be formed from cannabigerolic acid ("CBGA") as substrate. The molecular formula and formula weight of cannabielsoic acid ("CBEA") is $C_{22}H_{30}O_5$ and 374.5, respectively. The respective molecular formula and formula weight of cannabielsoin (decarboxylated CBEA) is $C_{21}H_{30}O_3$ and 330.5. The molecular formula and formula weight of all other compounds shown are $C_{22}H_{30}O_4$ and 358.5, respectively. CBCA=cannabichromenic acid, CBTA=cannabicitranic acid, CBDA=cannabidiolic acid, THICA=tetrahydroisocannabinolic acid, THCA=tetrahydrocannabinolic acid, and CBLA=cannabicyclolic acid.

Disclosed are enzymes that catalyze the biosynthesis of cannabinoids from CBGA. These enzymes, not previously known as cannabinoid synthases, are from organisms other than *Cannabis sativa*. The enzymes can be recombinantly expressed in *Saccharomyces cerevisiae* and *Pichia pastoris* in an active form.

The method summarized above for producing a cannabinoid requires contacting CBGA with a cannabinoid synthase orthologue not from *Cannabis sativa*. The source of the cannabinoid synthase orthologue can be, but is not limited to, *Citrus sinensis, Brassica napus, Nicotiana attenuate, Gossypium hirsutum, Oryza sativa* subsp. *indica*, *Oryza*

*sativa* subsp. *japonica*, *Arabidopsis lyrata* subsp. *lyrata*, *Paenibacillus* sp. Aloe-11, *Streptomyces ipomoeae* 91-03, *Brassica rapa* subsp. *pekinensis*, *Prunus persica*, *Bacillus subtilis* 168, *Arabidopsis thaliana*, *Papaver somniferum*, and *Phytophthora parasitica* P1569.

The cannabinoid synthase orthologue can be, but is not limited to, those shown in Tables 1 and 2 below. Exemplary cannabinoid synthase orthologues can have the amino acid sequence of SEQ ID NOs: 7, 16, 23, 31, 37, 47, 57, 67, 77, 87, 97, 107, 117, and 127, or a sequence having 70% or greater (e.g., 70%, 75%, 80%, 85%, 90%, 95%, and 99%) identity to SEQ ID NOs: 7, 16, 23, 31, 37, 47, 57, 67, 77, 87, 97, 107, 117, and 127.

The method set forth above can produce cannabinoids having a formula weight of 358.5 g/mol, 374.5 g/mol, or 330.5 g/mol. In a particular method, cannabinoids having a formula weight of 358.5 g/mol, 374.5 g/mol, and 330.5 g/mol are each produced.

Another method produces cannabielsoic acid and cannabielsoin. An example of this method produces cannabinoids that include both cannabielsoic acid and cannabielsoin but the products are free of any cannabinoid having a formula weight of 358.5 g/mol. In this exemplary method, the cannabinoid synthase orthologue includes the amino acid sequence of SEQ ID NOs: 67, 77, 97, or 127 or a sequence having 70% or greater identity to SEQ ID NOs: 67, 77, 97, or 127.

In the methods described above, the cannabinoid synthase orthologue can be a recombinant enzyme. The recombinant enzyme can be produced in, e.g., *Saccharomyces cerevisiae*, *Yarrowia lipolytica*, *Kluyveromyces marxianus*, and *Pichia pastoris*. A specific method features a recombinant enzyme produced in *Saccharomyces cerevisiae* or *Pichia pastoris*.

Also mentioned above is a recombinant cell of *Saccharomyces cerevisiae* or *Pichia pastoris* contains in its genome a nucleic acid encoding a cannabinoid synthase orthologue. The orthologue is from an organism other than *Cannabis sativa*. Exemplary sources of the cannabinoid synthase orthologue are listed above and shown in Tables 1 and 2 below.

The recombinant cell can contain a nucleic acid that encodes a cannabinoid synthase orthologue that includes an amino acid sequence selected from the group consisting of SEQ ID NOs: 7, 16, 23, 31, 37, 47, 57, 67, 77, 87, 97, 107, 117, and 127, or a sequence having 70% or greater (e.g., 70%, 75%, 80%, 85%, 90%, 95%, and 99%) identity to SEQ ID NOs: 7, 16, 23, 31, 37, 47, 57, 67, 77, 87, 97, 107, 117, and 127.

Without further elaboration, it is believed that one skilled in the art can, based on the disclosure herein, utilize the present disclosure to its fullest extent. The following specific examples are, therefore, to be construed as merely descriptive, and not limitative of the remainder of the disclosure in any way whatsoever. All publications cited herein are incorporated by reference in their entirety.

EXAMPLES

Example 1: Identification and Preparation of Potential Cannabinoid Synthases Based on its sequence, THCA synthase can be classified as a berberine-bridge FAD-dependent enzyme. Through a search of available sequence databases, 232 related genes were identified that are annotated in the UniProt database as berberine-bridge FAD dependent enzymes. In other words, these 232 genes were potential cannabinoid synthase orthologues.

Each gene sequence was codon-optimized for *S. cerevisiae* protein expression, synthesized, and cloned into pYES2-CT vector (Thermo Fisher). The vectors were transformed separately into *S. cerevisiae* BY4741 cells using chemical treatment and grown on SC-URA-glucose selection plates for two days at 30° C. Three single colonies from each plate were picked and replicated onto SC-URA-glucose selection plates and incubated for two days at 30° C. The replicated colonies were grown in 10 mL SC-URA-glucose media for 16 h at 30° C. The cells were then harvested and resuspended in 5 mL SC-URA-galactose media and grown for protein expression for 16 h at 30° C. After 16 h, the cells were harvested again and stored at −20° C. Cells not carrying any cannabinoid synthase orthologue were also prepared as above to serve as a negative control.

The cells were resuspended in 400 µL of 100 mM citrate buffer, pH 5.5 with 1 mM $MgCl_2$ and 5 units of lyticase. The cells were incubated at 37° C. with shaking for 1 h. One gram of glass beads was added to the suspension and the cells were cracked open using the MP Biomedical FastPrep 24 Tissue Homogenizer. Cell debris was removed by centrifugation for 30 min. at 14,800 rpm at 4° C.

Example 2: Enzymatic Assay

The potential cannabinoid synthase orthologues were tested for enzymatic activity as follows. In a reaction volume of 55 µL, 2.5 µL of 1 mg/mL CBGA, 2.5 µL of 20 mM FAD, and 50 µL of yeast cell supernatants prepared as above were combined and incubated under ambient conditions. A corresponding control reaction lacking CBGA was also carried out. After 24 h, the reactions were extracted three times with ethyl acetate. Samples of the extracted material were dried under vacuum and redissolved in acetonitrile for mass analysis using negative ion mode. EIC for m/z=357.5 and m/z=373.5 were generated for each sample to determine if the biosynthesis of a cannabinoid was catalyzed by the orthologues. The potential reaction products are shown in FIG. 1.

For each potential cannabinoid synthase orthologue, three single yeast colonies were picked and grown as mentioned above. The cell supernatant prepared from each colony was split into six portions. Three portions were incubated with CBGA and three portions were not incubated with CBGA as the negative control reaction. In total, for each potential orthologue, nine reactions were performed in the presence of CBGA and nine reactions were not incubated with CBGA.

A sample incubated with CBGA was considered to be positive for cannabinoid synthesis if the extracted material had a chromatographic peak area in EIC having an abundance of at least 800,000 at m/z=357.5 and/or m/z=373.5. A potential cannabinoid synthase orthologue was considered to be positive if seven out of the nine total reactions with CBGA were positive using the above criteria. The results are shown in Table 1 below, as well as in FIGS. 2A-2C and FIGS. 3A-3C.

Figure 2A:
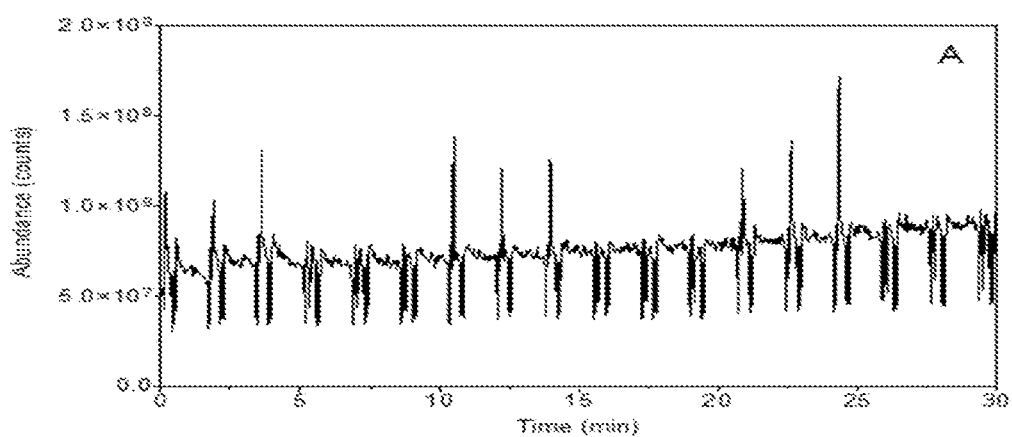
FIG. 2A shows a representative total ion chromatogram of 18 reaction sets of cannabinoid synthase orthologues. Each reaction set took 1.7 min to analyze.
Figure 2B:
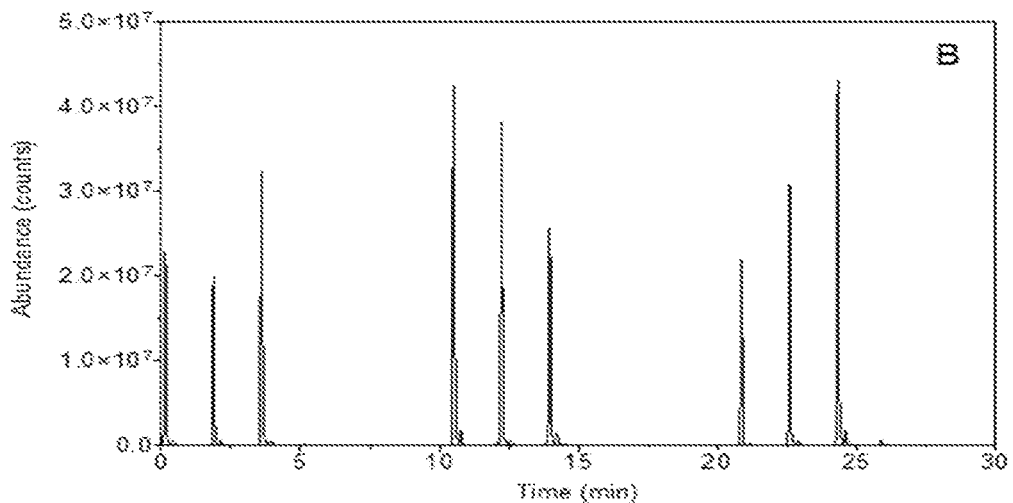
FIG. 2B shows a representative extracted ion chromatogram ("EIC") of the 18 reaction sets of cannabinoid synthase orthologues obtained at mass to charge ratio "(m/z)"=359.5 showing the presence of CBGA that was added to 9 of the 18 reaction sets, i.e., sets 1-3, 7-9, 13-15.
Figure 2C:
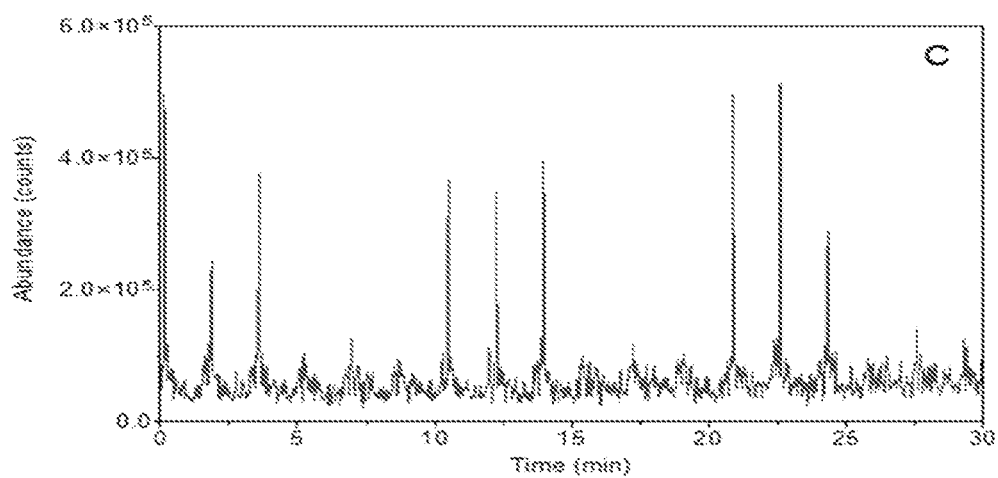
FIG. 2C shows a representative EIC of the 18 reaction sets that exhibited the production of a cannabinoid having at m/z=357.5.
Figure 3A:
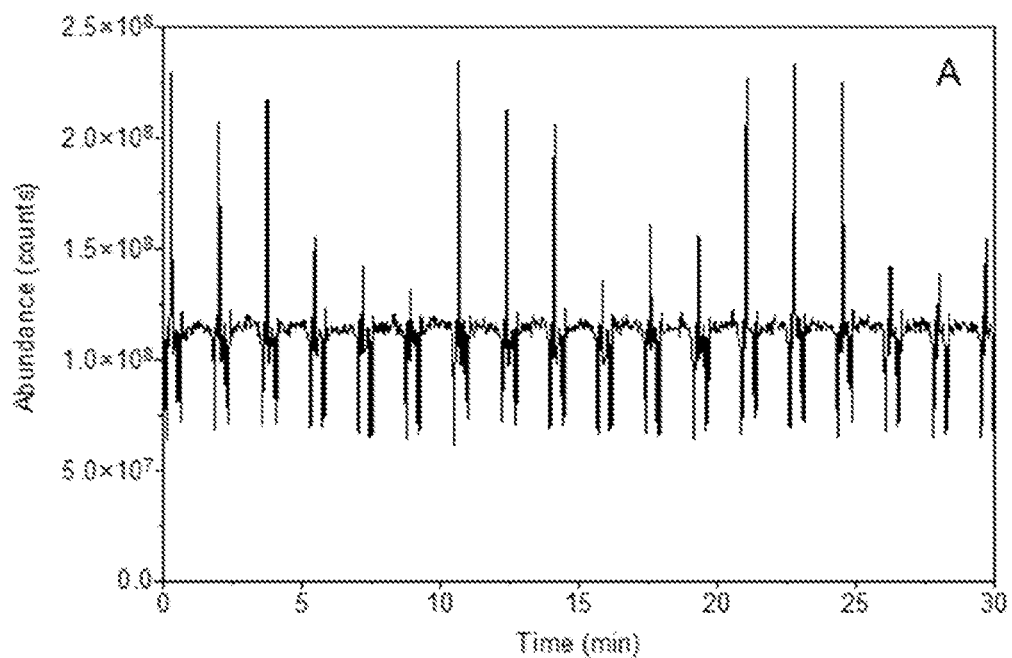
FIG. 3A shows a total-ion chromatograph of a group of 18 cannabinoid synthase orthologues. Each reaction set took 1.7 min.
Figure 3B:
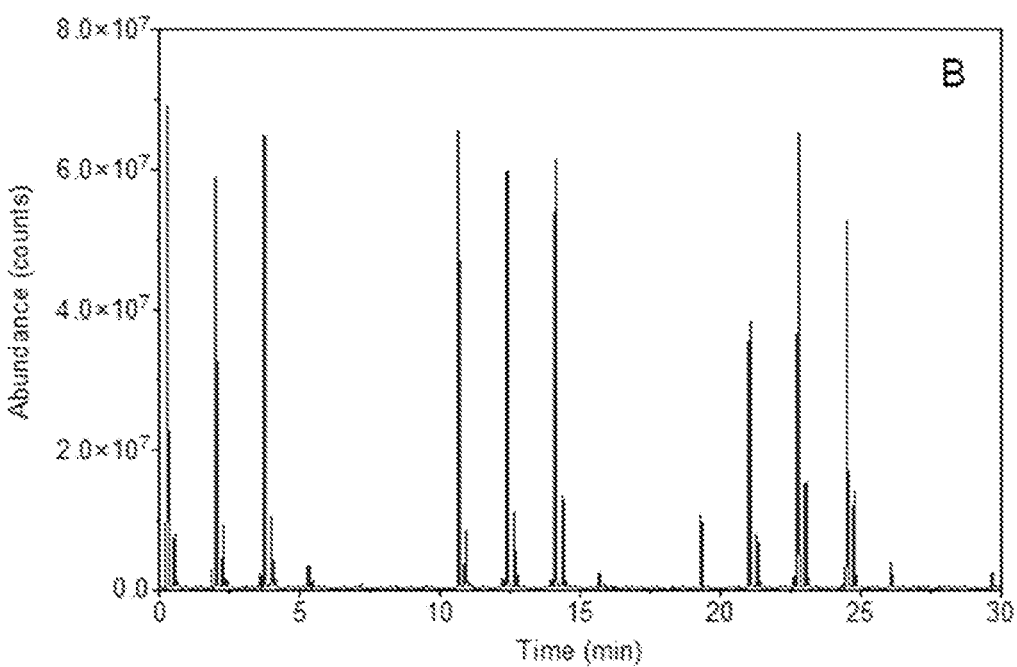
FIG. 3B shows a representative EIC of the 18 reaction sets of cannabinoid synthase orthologues obtained at m/z=359.5 showing the presence of CBGA that was added to 9 of the 18 reaction sets, i.e., sets 1-3, 7-9, 13-15.
Figure 3C:
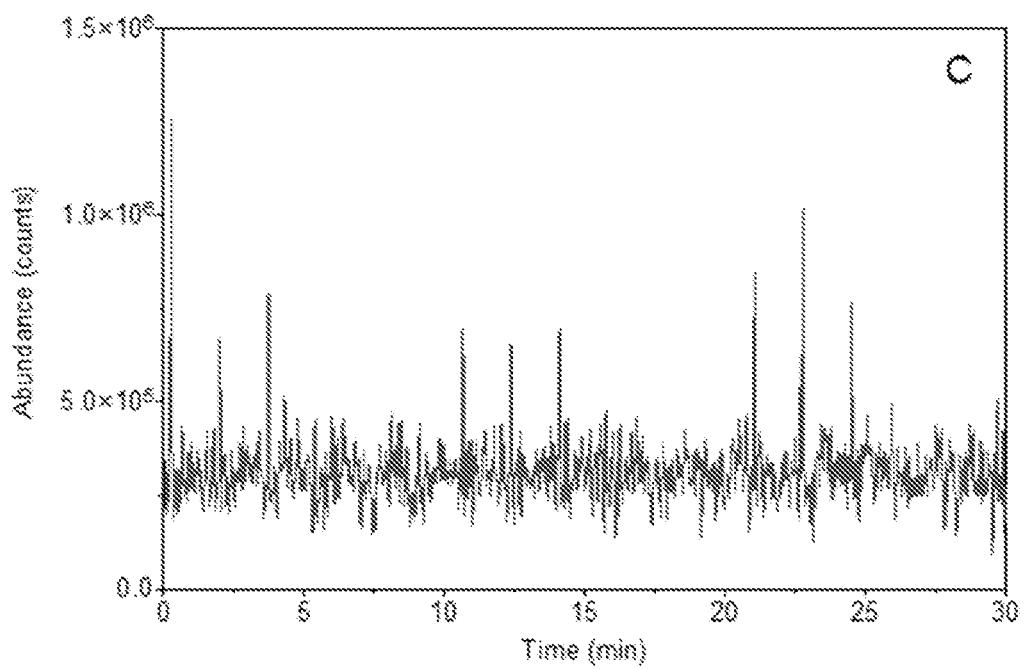
FIG. 3C shows a representative EIC of the 18 reaction sets that exhibited the production of a cannabinoid having at m/z=357.5.

FIGS. 2A-2C and 3A-3C are representative chromatograms of a Rapid-Fire/Triple Quad mass analysis. FIG. 2C shows a representative chromatogram showing the presence of a peak at m/z 357.5. FIG. 3C shows a representative chromatogram comparing the presence of a peak at m/z 373.5.

TABLE 1

Activity of cannabinoid synthase orthologues expressed in *S. cerevisiae*

| UniProt ID (SEQ ID NO) | Organism | m/z = 357.5 | m/z = 373.5 |
|---|---|---|---|
| A0A067ESH1 | *Citrus sinensis* | Yes | No |
| A0A078IY96 | *Brassica napus* | Yes | Yes |
| A0A1J6KPK0 (23) | *Nicotiana attenuata* | Yes | No |
| A0A1U8INJ7 | *Gossypium hirsutum* | Yes | No |
| A2YDX4 | *Oryza sativa* subsp. *indica* | Yes | No |
| A2YRE8 | *Oryza sativa* subsp. *indica* (Rice) | No | Yes |
| A3A4W8 | *Oryza sativa* subsp. *japonica* | Yes | No |
| A3CBG3 | *Oryza sativa* subsp. *japonica* | Yes | No |
| D7MMG9 (7) | *Arabidopsis lyrata* subsp. *lyrata* | Yes | No |
| H6CS09 | *Paenibacillus* sp. Aloe-11 | Yes | No |
| L1KS92 | *Streptomyces ipomoeae* 91-03 | Yes | No |
| L1KUA4 | *Streptomyces ipomoeae* 91-03 | Yes | No |
| M4DIE5 (16) | *Brassica rapa* subsp. *pekinensis* | Yes | Yes |
| M5WQ23 | *Prunus persica* | Yes | Yes |
| M5X864 (31) | *Prunus persica* | Yes | Yes |
| O06997 | *Bacillus subtilis* (strain 168) | Yes | No |
| O64743 | *Arabidopsis thaliana* | No | Yes |
| O64745 (37) | *Arabidopsis thaliana* | No | Yes |
| P93479 (47) | *Papaver somniferum* | Yes | Yes |
| Q93ZA3 | *Arabidopsis thaliana* | No | Yes |
| Q9FKU8 | *Arabidopsis thaliana* | Yes | No |
| Q9FKU9 | *Arabidopsis thaliana* | Yes | No |
| Q9FKV2 | *Arabidopsis thaliana* | Yes | No |
| Q9FZC5 | *Arabidopsis thaliana* | Yes | No |
| Q9FZC7 | *Arabidopsis thaliana* | No | Yes |
| Q9SA86 | *Arabidopsis thaliana* | No | Yes |
| Q9SA89 | *Arabidopsis thaliana* | No | Yes |
| Q9SVG3 | *Arabidopsis thaliana* | No | Yes |
| Q9SVG4 | *Arabidopsis thaliana* | No | Yes |
| Q9SVG7 | *Arabidopsis thaliana* | No | Yes |
| V9EEP8 | *Phytophthora parasitica* P1569 | No | Yes |

Out of the 72 cannabinoid synthase orthologues tested, 20 showed the production of a cannabinoid with a molecular formula of $C_{22}H_{30}O_4$ (MW=358.5; m/z 357.5) and 16 orthologues showed the production of a cannabinoid with a molecular formula of $C_{22}H_{30}O_4$ (MW=374.5; m/z 373.5). Five orthologues showed the production of both types of cannabinoids. See Table 1 above.

Example 3: Cannabinoid Synthase Orthologue Expression in *Pichia pastoris*

Genes encoding orthologues that showed cannabinoid synthase activity using CBGA as substrate were cloned into a *P. pastoris* expression system for larger scale protein expression. The expression of THCA synthase in *P. pastoris* was previously demonstrated. See, e.g., Zirpel et al., Biotechnology Lett. 2015, 37(9):1869-1875 and Lange et al., J. Biotechnol. 2015, 211:68-76.

The genes were cloned into the pPICZA plasmid (Invitrogen) and subsequently integrated into the *P. pastoris* genome using standard techniques. The resulting *P. pastoris* integrants were inoculated from agar plates and incubated in 20 mL buffered complex glycerol medium in baffled flasks at 30° C. for 48 h with shaking at 190 rpm. Cells were harvested by centrifugation and resuspended in 200 mL buffered methanol complex medium containing 0.5% w/v casamino acids and 0.01% w/v riboflavin. The expression of orthologue proteins was induced by adding 1% methanol every 24 h for a total of 120 hr.

Cells were harvested by centrifugation and resuspended in Buffer A (100 mM Tris, pH 8.0 and 150 mM NaCl). The cells were lysed using an M110P Microfluidizer® (Microfluidics International Corp.). Cell debris was removed by centrifugation and the cell lysates were loaded onto a 5 mL StrepTrap™ HP column (Cytiva Life Sciences) with a flow rate of 1 mL/min. The column was washed with 25 mL Buffer A, i.e., 5 column volumes ("CV"), and eluted with 6 CV Buffer B (100 mM Tris, pH 8.0, 150 mM NaCl, and 2.5 mM desthiobiotin). Fractions containing protein, identified by an increase in absorbance at 280 nm, were pooled, concentrated, and frozen at −80° C.

In a reaction volume of 50 µL, the cannabinoid synthase purified from was incubated with 150 µM CBGA and 0.2 mM FAD in 50 mM citrate, pH 8.0. The reaction was incubated for 24-48 h at 30° C., followed by the addition of 160 µL of acetonitrile to stop the reaction and precipitate the protein. The mixture (120 µL) was injected into an Agilent InfinityLab Poroshell 120 EC-C18 column for mass analysis using the Agilent 1290 Infinity HPLC coupled with Agilent 6550 iFunnel Q-TOF high resolution mass spectrometer in the negative ion mode. EICs for m/z=357.2071, m/z=373.2020, and m/z=329.2122 were generated for each sample to determine if the biosynthesis of a potential cannabinoid was catalyzed by the orthologue.

Figure 4:
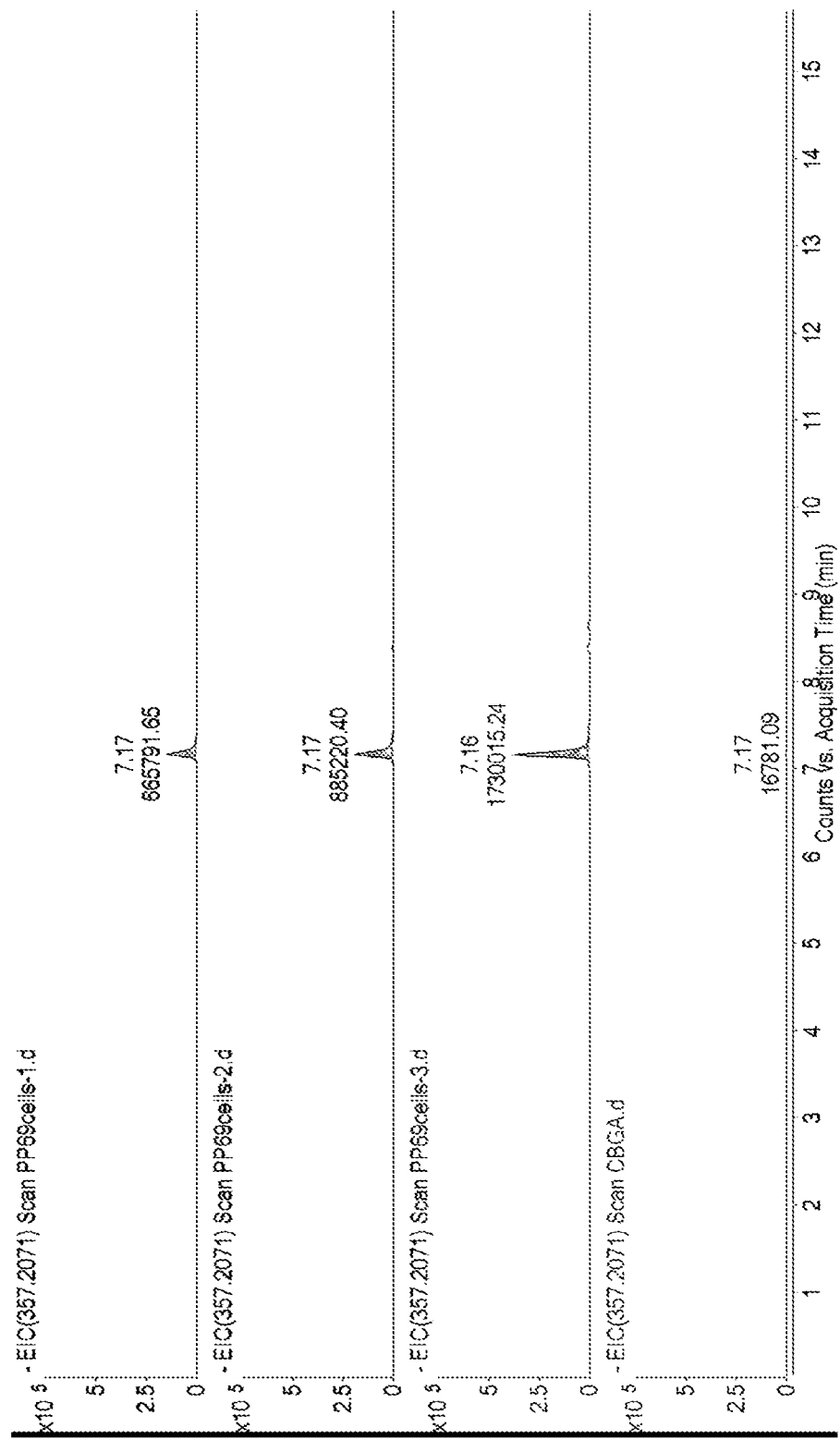
FIG. 4. shows a representative chromatogram of a cannabinoid synthase orthologue that produced a cannabinoid having m/z=357.2071. Each reaction set took 15.70 min. to analyze. Chromatograms in rows 1, 2, and 4 show the presence of a peak when CBGA was incubated with a positive cannabinoid synthase orthologue, the peak being 65-fold larger than the peak found in the control experiment (row 3) performed in the absence of a cannabinoid synthase orthologue.
Figure 5:
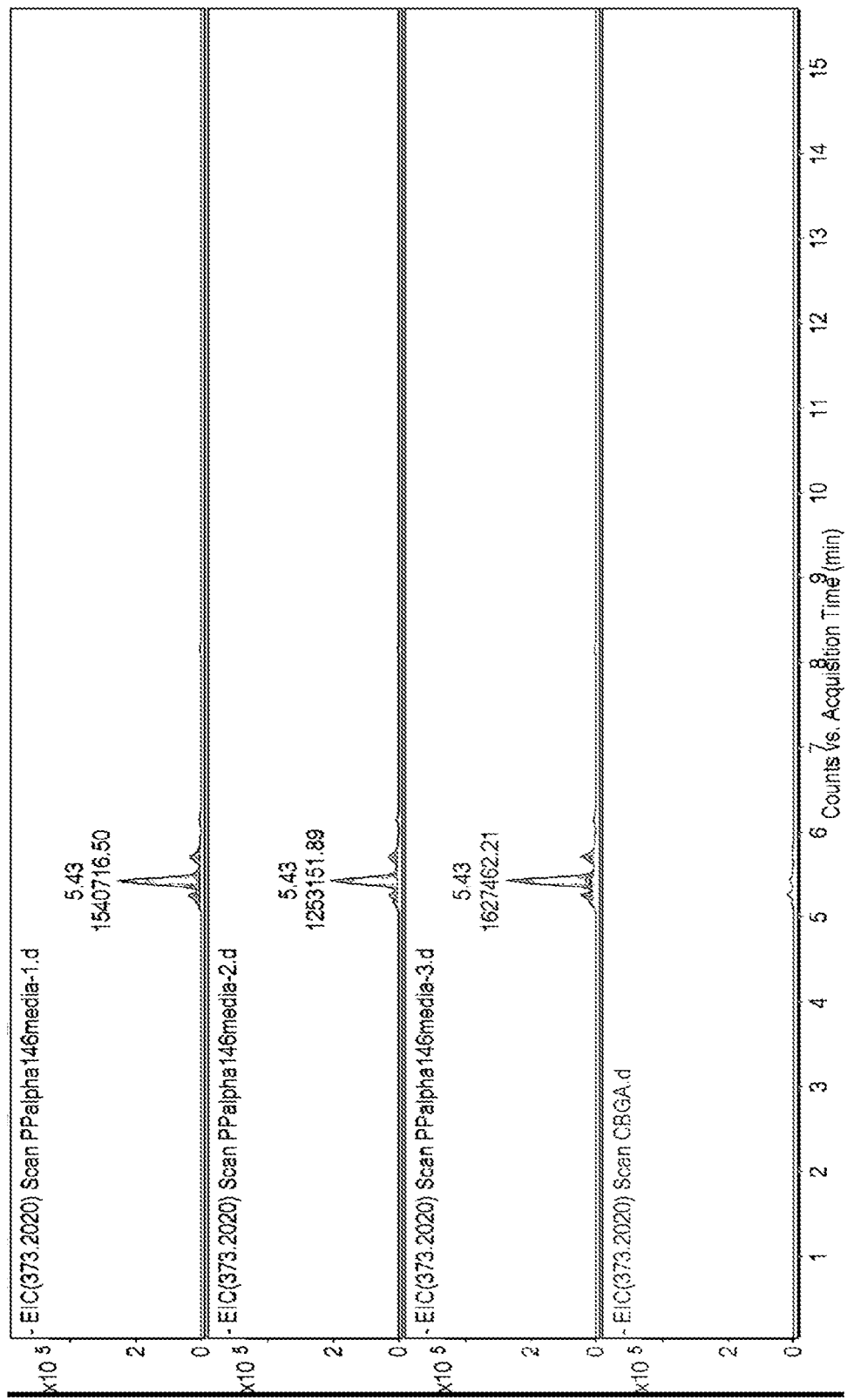
FIG. 5 shows a representative chromatogram of a cannabinoid synthase orthologue that produced a cannabinoid having m/z=373.2020. Each reaction set took 15.70 min. to analyze. Chromatograms in rows 2-4 show the presence of a peak when CBGA was incubated with a positive cannabinoid synthase orthologue, the peak being 120-fold larger than the peak found in the control experiment (row 1) performed in the absence of a cannabinoid synthase orthologue.
Figure 6:
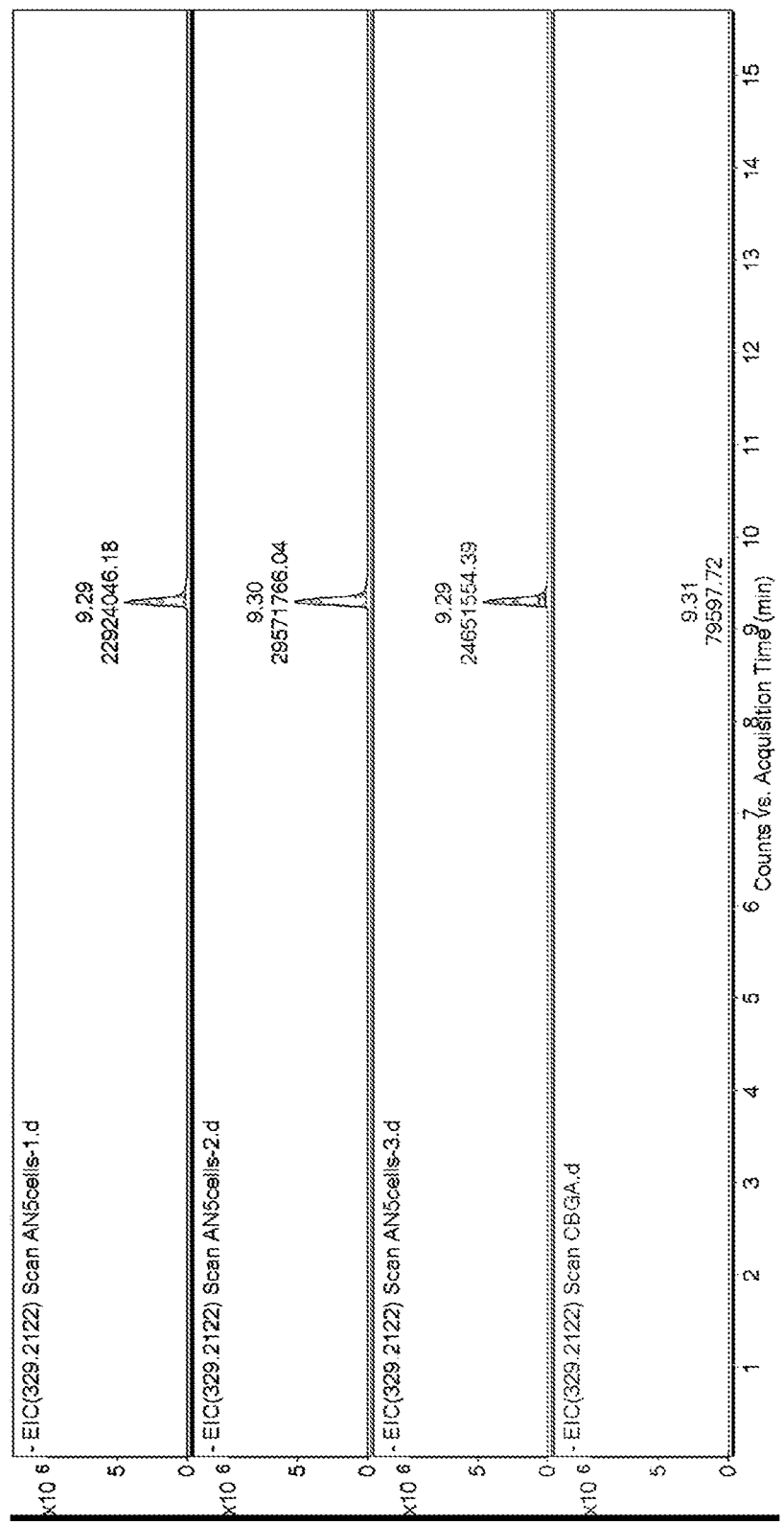
FIG. 6 shows a representative chromatogram of a cannabinoid synthase orthologue that produced a cannabinoid having m/z=329.2122. Each reaction set took 15.70 min. to analyze. Chromatograms in rows 1, 2, and 4 show the presence of a peak when CBGA was incubated with a positive cannabinoid synthase orthologue, the peak being 300-fold larger than the peak found in the control experiment (row 3) performed in the absence of a cannabinoid synthase orthologue.

The results are shown in FIGS. 4-6 and Table 2 below.

TABLE 2

Activity of cannabinoid synthase orthologues expressed in *P. pastoris*

| UniProt ID (SEQ ID NO) | Organism | m/z = 357.2071 | m/z = 373.2020 | m/z = 329.2122 |
|---|---|---|---|---|
| D7MMG9 (7) | *Arabidopsis lyrata* subsp. *lyrata* | Yes | No | No |
| M4DIE5 (16) | *Brassica rapa* subsp. *pekinensis* | Yes | Yes | Yes |
| A0A1J6KPK0 (23) | *Nicotiana attenuata* | Yes | Yes | Yes |
| M5X864 (31) | *Prunus persica* | Yes | No | No |
| O64745 (37) | *Arabidopsis thaliana* | Yes | No | No |
| P93479 (47) | *Papaver somniferum* | Yes | Yes | Yes |
| A0A1U8G0D2 (57) | *Capsicum annuum* | Yes | Yes | Yes |
| A0A1S3XA06 (67) | *Nicotiana tabacum* | No | Yes | Yes |

TABLE 2-continued

Activity of cannabinoid synthase orthologues expressed in *P. pastoris*

| UniProt ID (SEQ ID NO) | Organism | m/z = 357.2071 | m/z = 373.2020 | m/z = 329.2122 |
|---|---|---|---|---|
| A0A1S3BDA8 (77) | *Cucumis melo* | No | Yes | Yes |
| A0A1U8FGM5 (87) | *Capsicum annuum* | Yes | Yes | Yes |
| A0A1U8MHW2 (97) | *Gossypium hirsutum* (*Gossypium mexicanum*) | No | Yes | Yes |
| A0A1J3CT99 (107) | *Noccaea caerulescens* (*Thlaspi caerulescens*) | Yes | Yes | Yes |
| A0A1J3J6A2 (117) | *Noccaea caerulescens* (*Thlaspi caerulescens*) | Yes | Yes | Yes |
| A0A1S3BE31 (127) | *Cucumis melo* | No | Yes | Yes |

Out of the 232 potential CBS orthologs screened, seven orthologs showed the production of two types of cannabinoids, (i) the "cannabidiolic acid group" type having a molecular formula of $C_{22}H_{30}O_4$ (FW=358.5; m/z=357.2071, see FIG. 4) and (ii) cannabielsoic acid, with a molecular formula of $C_{22}H_{30}O_4$ (FW=374.5; m/z=373.2020, see FIG. 5). The decarboxylated product of cannabielsoic acid, namely, cannabielsoin, having a molecular formula of $C_{21}H_{30}O_2$ (FW=330.5; m/z=329.2122, see FIG. 6) was also observed. Three orthologues produced only cannabinoids of the cannabidiolic acid group. Four orthologues produced only cannabielsoic acid and cannabielsoin.

Other Embodiments

All of the features disclosed in this specification may be combined in any combination. Each feature disclosed in this specification may be replaced by an alternative feature serving the same, equivalent, or similar purpose. Thus, unless expressly stated otherwise, each feature disclosed is only an example of a generic series of equivalent or similar features.

From the above description, one skilled in the art can easily ascertain the essential characteristics of the present invention, and without departing from the spirit and scope thereof, can make various changes and modifications of the invention to adapt it to various usages and conditions. Thus, other embodiments are also within the scope of the following claims.

SEQUENCE LISTING (135 sequences)

SEQ ID NO: 1 - DNA, 24 bp, Artificial Sequence
  Strep Tag
  CDS (1)..(24)
tggtcacatccacaatttgaaaag

SEQ ID NO: 2 - protein, 8 aa, Artificial Sequence
  Synthetic Construct
WSHPQFEK

SEQ ID NO: 3 - DNA, 57 bp, Artificial Sequence
  truncated alpha factor
  CDS (1)..(57)
atgagatttccttccatcttcacggctgtgctatttgcagcatcctccgcacttgca

SEQ ID NO: 4 - protein, 19 aa, Artificial Sequence
  Synthetic Construct
MRFPSIFTAVLFAASSALA

SEQ ID NO: 5 - DNA, 267 bp, Artificial Sequence
  alpha factor full
  CDS (1)..(267)
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagct

SEQ ID NO: 6 - protein, 89 aa, Artificial Sequence
  Synthetic Construct
MRFPSIFTAVLFAASSALAAPVNTTTEDETAQIPAEAVIGYSDLEGDFDVAVLPFSNSTNNGLLFINTTIASIAAKEEGVSLEKREAEA

SEQ ID NO: 7 - DNA, 1431 bp, Artificial Sequence
  CBS1-D7MMG9
  CDS (1)..(1431)
atgaaccacaacaccgttgaatccaaggttattcatacctccaaggactcttcattcttctccattttggactcctctattcagaacccaagattctctgtttctgaaactccaaagccagtttccattattactccagttaaggcctctgatgttcaaaccgttattagatgtgctagattgcatggtatccacgttagaactagatctgctggtcattgctatgaaggcttgtcttatattgcttacaacaagccattcgtcgtcatcgacattagaaacttgcaatccatctccttggatgttgataatagaactggttgggttcaaactggtgctactgctggtgaactatattacgaaattggtaagactccaaagaccttggcttttccagctggtattcatccaactgttgctgccgataacattattgatgctttggttgttgatgcctccggtagaattttggatagacaagctatgggtgaagagtactacttttgggctatttgcggtggtggtggttcttcttttggtattatcttgtcctggaagatcaagttggttgatgttccatctaccatcactgttttcaaggttaagaggacctctaagaaagaagccgttagaatcattaacaagtggcaatacgttgccgataaggttccagatgatttgttcattagaaccaccttggaaaggtctaacaagaatgctgttcatgctttgtttaccggcttgtatttgggtccagctaacaatttgttggccttgatggaagaaaagttcccagaattgggtttagaaaaggatggttgtactgaaatgtcctgggttgaatctgttttgtggtttgctgatttccacaagggtgaatctttggatgatgttttgaccaacagagaaaggacctctttgtcttacaaaggtaaggatgatttcgtgcaagagccaattccagaagctgctattcaagaactttggagaagattggatgctccagaagcaagattggccaagattattttgactccatttggtggtaagatgtccgaaattgctgaacacgaaactttgttcccacatagagaaggtaacttgtacgaaattcaatacgtcgcctattggagagaagaagaggataagaatatgactggcaccaacaaatacttgaagtgggttgattcagtctacgaattgatgactccatacgtttctaaatctccaagaggtgcttacgttaacttcgttgatatggatttgggtatgtacctgggtaagaaaaagaccaaatacgaagagggtaaatcctggggtgttaagtactttaagaacaacttcgaaagactggtcagagtcaagacttctgttgatccaactgatttcttctgcgacgaacaatctattcccttgttgaacaaagtcact

SEQ ID NO: 8 - protein, 477 aa, Artificial Sequence
  Synthetic Construct
MNHNTVESKVIHTSKDSSFFSILDSSIQNPRFSVSETPKPVSIITPVKASDVQTVIRCARLHGIHVRTRSAGHCYEGLSYIAYNKPFVVIDIRNLQSISLDVDNRTGWVQTGATAGELYYEIGKTPKTLAFPAGIHPTVAADNIIDALVVDASGRILDRQAMGEEYYFWAICGGGGSSFGIILSWKIKLVDVPSTITVFKVKRTSKKEAVRIINKWQYVADKVPDDLFIRTTLERSNKNAVHALFTGLYLGPANNLLALMEEKFPELGLEKDGCTEMSWVESVLWFADFHKGESLDDVLTNRERTSLSYKGKDDFVQEPIPEAAIQELWRRLDAPEARLAKIILTPFGGKMSEIAEHETLFPHREGNLYEIQYVAYWREEEDKNMTGTNKYLKWVDSVYELMTPYVSKSPRGAYVNFVDMDLGMYLGKKKTKYEEGKSWGVKYFKNNFERLVRVKTSVDPTDFFCDEQSIPLLNKVT

SEQ ID NO: 9 - DNA, 1455 bp, Artificial Sequence
  CBS1-D7MMG9-strep-Tag
  CDS (1)..(1455)
atgaaccacaacaccgttgaatccaaggttattcatacctccaaggactcttcattcttctccattttggactcctctattcagaacccaagattctctgtttctgaaactccaaagccagtttccattattactccagttaaggcctctgatgttcaaaccgttattagatgtgctagattgcatggtatccacgttagaactagatctgctggtcattgctatgaaggcttgtcttatattgcttacaacaagccattcgtcgtcatcgacattagaaacttgcaatccatctccttggatgttgataatagaactggttgggttcaaactggtgctactgctggtgaactatattacgaaattggtaagactccaaagaccttggcttttccagctggtattcatccaactgttgctgccgataacattattgatgctttggttgttgatgcctccggtagaattttggatagacaagctatgggtgaagagtactacttttgggctatttgcggtggtggtggttcttcttttggtattatcttgtcctggaagatcaagttggttgatgttccatctaccatcactgttttcaaggttaagaggacctctaagaaagaagccgttagaatcattaacaagtggcaatacgttgccgataaggttccagatgatttgttcattagaaccaccttggaaaggtctaacaagaatgctgttcatgctttgtttaccggcttgtatttgggtccagctaacaatttgttggccttgatggaagaaaagttcccagaattgggtttagaaaaggatggttgtactgaaatgtcctgggttgaatctgttttgtggtttgctgatttccacaagggtgaatctttggatgatgttttgaccaacagagaaaggacctctttgtcttacaaaggtaaggatgatttcgtgcaagagccaattccagaagctgctattcaagaactttggagaagattggatgctccagaagcaagattggccaagattattttgactccatttggtggtaagatgtccgaaattgctgaacacgaaactttgttcccacatagagaaggtaacttgtacgaaattcaatacgtcgcctattggagagaagaagaggataagaatatgactggcaccaacaaatacttgaagtgggttgattcagtctacgaattgatgactccatacgtttctaaatctccaagaggtgcttacgttaacttcgttgatatggatttgggtatgtacctgggtaagaaaaagaccaaatacgaagagggtaaatcctggggtgttaagtactttaagaacaacttcgaaagactggtcagagtcaagacttctgttgatccaactgatttcttctgcgacgaacaatctattcccttgttgaacaaagtcacttggtcacatccacaatttgaaaag

SEQ ID NO: 10 - protein, 485 aa, Artificial Sequence
  Synthetic Construct
MNHNTVESKVIHTSKDSSFFSILDSSIQNPRFSVSETPKPVSIITPVKASDVQTVIRCARLHGIHVRTRSAGHCYEGLSYIAYNKPFVVIDIRNLQSISLDVDNRTGWVQTGATAGELYYEIGKTPKTLAFPAGIHPTVAADNIIDALVVDASGRILDRQAMGEEYYFWAICGGGGSSFGIILSWKIKLVDVPSTITVFKVKRTSKKEAVRIINKWQYVADKVPDDLFIRTTLERSNKNAVHALFTGLYLGPANNLLALMEEKFPELGLEKDGCTEMSWVESVLWFADFHKGESLDDVLTNRERTSLSYKGKDDFVQEPIPEAAIQELWRRLDAPEARLAKIILTPFGGKMSEIAEHETLFPHREGNLYEIQYVAYWREEEDKNMTGTNKYLKWVDSVYELMTPYVSKSPRGAYVNFVDMDLGMYLGKKKTKYEEGKSWGVKYFKNNFERLVRVKTSVDPTDFFCDEQSIPLLNKVTWSHPQFEK

SEQ ID NO: 11 - DNA, 1512 bp, Artificial Sequence
  CBS1-D7MMG9- truncated alpha factor strep Tag
  CDS (1)..(1512)
atgagatttccttccatcttcacggctgtgctatttgcagcatcctccgcacttgcaatgaaccacaacaccgttgaatccaaggttattcatacctccaaggactcttcattcttctccattttggactcctctattcagaacccaagattctctgtttctgaaactccaaagccagtttccattattactccagttaaggcctctgatgttcaaaccgttattagatgtgctagattgcatggtatccacgttagaactagatctgctggtcattgctatgaaggcttgtcttatattgcttacaacaagccattcgtcgtcatcgacattagaaacttgcaatccatctccttggatgttgataatagaactggttgggttcaaactggtgctactgctggtgaactatattacgaaattggtaagactccaaagaccttggcttttccagctggtattcatccaactgttgctgccgataacattattgatgctttggttgttgatgcctccggtagaattttggatagacaagctatgggtgaagagtactacttttgggctatttgcggtggtggtggttcttcttttggtattatcttgtcctggaagatcaagttggttgatgttccatctaccatcactgttttcaaggttaagaggacctctaagaaagaagccgttagaatcattaacaagtggcaatacgttgccgataaggttccagatgatttgttcattagaaccaccttggaaaggtctaacaagaatgctgttcatgctttgtttaccggcttgtatttgggtccagctaacaatttgttggccttgatggaagaaaagttcccagaattgggtttagaaaaggatggttgtactgaaatgtcctgggttgaatctgttttgtggtttgctgatttccacaagggtgaatctttggatgatgttttgaccaacagagaaaggacctctttgtcttacaaaggtaaggatgatttcgtgcaagagccaattccagaagctgctattcaagaactttggagaagattggatgctccagaagcaagattggccaagattattttgactccatttggtggtaagatgtccgaaattgctgaacacgaaactttgttcccacatagagaaggtaacttgtacgaaattcaatacgtcgcctattggagagaagaagaggataagaatatgactggcaccaacaaatacttgaagtgggttgattcagtctacgaattgatgactccatacgtttctaaatctccaagaggtgcttacgttaacttcgttgatatggatttgggtatgtacctgggtaagaaaaagaccaaatacgaagagggtaaatcctggggtgttaagtactttaagaacaacttcgaaagactggtcagagtcaagacttctgttgatccaactgatttcttctgcgacgaacaatctattcccttgttgaacaaagtcacttggtcacatccacaatttgaaaag

SEQ ID NO: 12 - protein, 504 aa, Artificial Sequence
  Synthetic Construct
MRFPSIFTAVLFAASSALAMNHNTVESKVIHTSKDSSFFSILDSSIQNPRFSVSETPKPVSIITPVKASDVQTVIRCARLHGIHVRTRSAGHCYEGLSYIAYNKPFVVIDIRNLQSISLDVDNRTGWVQTGATAGELYYEIGKTPKTLAFPAGIHPTVAADNIIDALVVDASGRILDRQAMGEEYYFWAICGGGGSSFGIILSWKIKLVDVPSTITVFKVKRTSKKEAVRIINKWQYVADKVPDDLFIRTTLERSNKNAVHALFTGLYLGPANNLLALMEEKFPELGLEKDGCTEMSWVESVLWFADFHKGESLDDVLTNRERTSLSYKGKDDFVQEPIPEAAIQELWRRLDAPEARLAKIILTPFGGKMSEIAEHETLFPHREGNLYEIQYVAYWREEEDKNMTGTNKYLKWVDSVYELMTPYVSKSPRGAYVNFVDMDLGMYLGKKKTKYEEGKSWGVKYFKNNFERLVRVKTSVDPTDFFCDEQSIPLLNKVTWSHPQFEK

SEQ ID NO: 13 - DNA, 1722 bp, Artificial Sequence
  CBS1-D7MMG9-full alpha factor -strep Tag
  CDS (1)..(1722)
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagctatgaaccacaacaccgttgaatccaaggttattcatacctccaaggactcttcattcttctccattttggactcctctattcagaacccaagattctctgtttctgaaactccaaagccagtttccattattactccagttaaggcctctgatgttcaaaccgttattagatgtgctagattgcatggtatccacgttagaactagatctgctggtcattgctatgaaggcttgtcttatattgcttacaacaagccattcgtcgtcatcgacattagaaacttgcaatccatctccttggatgttgataatagaactggttgggttcaaactggtgctactgctggtgaactatattacgaaattggtaagactccaaagaccttggcttttccagctggtattcatccaactgttgctgccgataacattattgatgctttggttgttgatgcctccggtagaattttggatagacaagctatgggtgaagagtactacttttgggctatttgcggtggtggtggttcttcttttggtattatcttgtcctggaagatcaagttggttgatgttccatctaccatcactgttttcaaggttaagaggacctctaagaaagaagccgttagaatcattaacaagtggcaatacgttgccgataaggttccagatgatttgttcattagaaccaccttggaaaggtctaacaagaatgctgttcatgctttgtttaccggcttgtatttgggtccagctaacaatttgttggccttgatggaagaaaagttcccagaattgggtttagaaaaggatggttgtactgaaatgtcctgggttgaatctgttttgtggtttgctgatttccacaagggtgaatctttggatgatgttttgaccaacagagaaaggacctctttgtcttacaaaggtaaggatgatttcgtgcaagagccaattccagaagctgctattcaagaactttggagaagattggatgctccagaagcaagattggccaagattattttgactccatttggtggtaagatgtccgaaattgctgaacacgaaactttgttcccacatagagaaggtaacttgtacgaaattcaatacgtcgcctattggagagaagaagaggataagaatatgactggcaccaacaaatacttgaagtgggttgattcagtctacgaattgatgactccatacgtttctaaatctccaagaggtgcttacgttaacttcgttgatatggatttgggtatgtacctgggtaagaaaaagaccaaatacgaagagggtaaatcctggggtgttaagtactttaagaacaacttcgaaagactggtcagagtcaagacttctgttgatccaactgatttcttctgcgacgaacaatctattcccttgttgaacaaagtcacttggtcacatccacaatttgaaaag

SEQ ID NO: 14 - protein, 574 aa, Artificial Sequence
  Synthetic Construct
MRFPSIFTAVLFAASSALAAPVNTTTEDETAQIPAEAVIGYSDLEGDFDVAVLPFSNSTNNGLLFINTTIASIAAKEEGVSLEKREAEAMNHNTVESKVIHTSKDSSFFSILDSSIQNPRFSVSETPKPVSIITPVKASDVQTVIRCARLHGIHVRTRSAGHCYEGLSYIAYNKPFVVIDIRNLQSISLDVDNRTGWVQTGATAGELYYEIGKTPKTLAFPAGIHPTVAADNIIDALVVDASGRILDRQAMGEEYYFWAICGGGGSSFGIILSWKIKLVDVPSTITVFKVKRTSKKEAVRIINKWQYVADKVPDDLFIRTTLERSNKNAVHALFTGLYLGPANNLLALMEEKFPELGLEKDGCTEMSWVESVLWFADFHKGESLDDVLTNRERTSLSYKGKDDFVQEPIPEAAIQELWRRLDAPEARLAKIILTPFGGKMSEIAEHETLFPHREGNLYEIQYVAYWREEEDKNMTGTNKYLKWVDSVYELMTPYVSKSPRGAYVNFVDMDLGMYLGKKKTKYEEGKSWGVKYFKNNFERLVRVKTSVDPTDFFCDEQSIPLLNKVTWSHPQFEK

SEQ ID NO: 15 - DNA, 1011 bp, Artificial Sequence
  CBS5-M4DIE5
  CDS (1)..(1011)
atgaggaagtacggtttgaccgttgataatgttgttgatgccttgatcgttgatgttaacggcaagttgttgaacagatctactatgggtgaagatttgttctgggctattagaggtggtggtggcggttcttttggtgttattttgtcttggaagatcaacttggttgacgtcccagaaattttgactgttttcagagttaacaagaccttggaacaaggtggtattgacgtcttgtacaaatggcaattggtgtcctctaagttgttggatggtttgtttttgagagccttgtctcaagttgtcaacagaactatcaccgttgaattttacgctcagtttttgggtagagccgatgaattggttgctatcgttaatcaatctttgccagagttgggtttgaagagacaagattgcttggaaatgtcttggttgaacactaccttgttttgggaagatttgccagttggtactccaacttctgttttgttggatagaccatctaagccagagaagttcttcaagtctaaatccgattacgtcaagaagcccattccaaaagagggtattaagaaattgtgggaagccttgttggagtttaacaacaacaatatcgtctacatgcagtggaatccatacggtggtgttatggatactgttccagctgctgctactccatttccacatagaaaaggtaacttgttcgaagtccagtactacacttcttggttggatgctaatgctacaatgggttctttggacatgatgaagaagttgtacgaagttgctgaaccctacgtttcttctaatccaagagaagcctttttgaactacagagacatcgacattggtagcaatccatctaacgaaactaatgttgaagaagccgaaatctacggctctaagtactttgttggtaacttgaagagattgatggaagtcaaggctaagtacgatccagaaaactttttcaagaacgagcaatctattccaccagccagagttaagcaa

SEQ ID NO: 16 - protein, 337 aa, Artificial Sequence
  Synthetic Construct
MRKYGLTVDNVVDALIVDVNGKLLNRSTMGEDLFWAIRGGGGGSFGVILSWKINLVDVPEILTVFRVNKTLEQGGIDVLYKWQLVSSKLLDGLFLRALSQVVNRTITVEFYAQFLGRADELVAIVNQSLPELGLKRQDCLEMSWLNTTLFWEDLPVGTPTSVLLDRPSKPEKFFKSKSDYVKKPIPKEGIKKLWEALLEFNNNNIVYMQWNPYGGVMDTVPAAATPFPHRKGNLFEVQYYTSWLDANATMGSLDMMKKLYEVAEPYVSSNPREAFLNYRDIDIGSNPSNETNVEEAEIYGSKYFVGNLKRLMEVKAKYDPENFFKNEQSIPPARVKQ

SEQ ID NO: 17 - DNA, 1035 bp, Artificial Sequence
  CBS5-M4DIE5 strep Tag
  CDS (1)..(1035)
atgaggaagtacggtttgaccgttgataatgttgttgatgccttgatcgttgatgttaacggcaagttgttgaacagatctactatgggtgaagatttgttctgggctattagaggtggtggtggcggttcttttggtgttattttgtcttggaagatcaacttggttgacgtcccagaaattttgactgttttcagagttaacaagaccttggaacaaggtggtattgacgtcttgtacaaatggcaattggtgtcctctaagttgttggatggtttgtttttgagagccttgtctcaagttgtcaacagaactatcaccgttgaattttacgctcagtttttgggtagagccgatgaattggttgctatcgttaatcaatctttgccagagttgggtttgaagagacaagattgcttggaaatgtcttggttgaacactaccttgttttgggaagatttgccagttggtactccaacttctgttttgttggatagaccatctaagccagagaagttcttcaagtctaaatccgattacgtcaagaagcccattccaaaagagggtattaagaaattgtgggaagccttgttggagtttaacaacaacaatatcgtctacatgcagtggaatccatacggtggtgttatggatactgttccagctgctgctactccatttccacatagaaaaggtaacttgttcgaagtccagtactacacttcttggttggatgctaatgctacaatgggttctttggacatgatgaagaagttgtacgaagttgctgaaccctacgtttcttctaatccaagagaagcctttttgaactacagagacatcgacattggtagcaatccatctaacgaaactaatgttgaagaagccgaaatctacggctctaagtactttgttggtaacttgaagagattgatggaagtcaaggctaagtacgatccagaaaactttttcaagaacgagcaatctattccaccagccagagttaagcaatggtcacatccacaatttgaaaag

SEQ ID NO: 18 - protein, 345 aa, Artificial Sequence
  Synthetic Construct
MRKYGLTVDNVVDALIVDVNGKLLNRSTMGEDLFWAIRGGGGGSFGVILSWKINLVDVPEILTVFRVNKTLEQGGIDVLYKWQLVSSKLLDGLFLRALSQVVNRTITVEFYAQFLGRADELVAIVNQSLPELGLKRQDCLEMSWLNTTLFWEDLPVGTPTSVLLDRPSKPEKFFKSKSDYVKKPIPKEGIKKLWEALLEFNNNNIVYMQWNPYGGVMDTVPAAATPFPHRKGNLFEVQYYTSWLDANATMGSLDMMKKLYEVAEPYVSSNPREAFLNYRDIDIGSNPSNETNVEEAEIYGSKYFVGNLKRLMEVKAKYDPENFFKNEQSIPPARVKQWSHPQFEK

SEQ ID NO: 19 - DNA, 1092 bp, Artificial Sequence
  CBS5-M4DIE5-truncated alpha factor strep Tag
atgagatttccttccatcttcacggctgtgctatttgcagcatcctccgcacttgcaatgaggaagtacggtttgaccgttgataatgttgttgatgccttgatcgttgatgttaacggcaagttgttgaacagatctactatgggtgaagatttgttctgggctattagaggtggtggtggcggttcttttggtgttattttgtcttggaagatcaacttggttgacgtcccagaaattttgactgttttcagagttaacaagaccttggaacaaggtggtattgacgtcttgtacaaatggcaattggtgtcctctaagttgttggatggtttgtttttgagagccttgtctcaagttgtcaacagaactatcaccgttgaattttacgctcagtttttgggtagagccgatgaattggttgctatcgttaatcaatctttgccagagttgggtttgaagagacaagattgcttggaaatgtcttggttgaacactaccttgttttgggaagatttgccagttggtactccaacttctgttttgttggatagaccatctaagccagagaagttcttcaagtctaaatccgattacgtcaagaagcccattccaaaagagggtattaagaaattgtgggaagccttgttggagtttaacaacaacaatatcgtctacatgcagtggaatccatacggtggtgttatggatactgttccagctgctgctactccatttccacatagaaaaggtaacttgttcgaagtccagtactacacttcttggttggatgctaatgctacaatgggttctttggacatgatgaagaagttgtacgaagttgctgaaccctacgtttcttctaatccaagagaagcctttttgaactacagagacatcgacattggtagcaatccatctaacgaaactaatgttgaagaagccgaaatctacggctctaagtactttgttggtaacttgaagagattgatggaagtcaaggctaagtacgatccagaaaactttttcaagaacgagcaatctattccaccagccagagttaagcaatggtcacatccacaatttgaaaag

SEQ ID NO: 20 - DNA, 1302 bp, Artificial Sequence
  CBS5-M4DIE5-nucleotide-full alpha factor strep Tag
  CDS (1)..(1302)
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagctatgaggaagtacggtttgaccgttgataatgttgttgatgccttgatcgttgatgttaacggcaagttgttgaacagatctactatgggtgaagatttgttctgggctattagaggtggtggtggcggttcttttggtgttattttgtcttggaagatcaacttggttgacgtcccagaaattttgactgttttcagagttaacaagaccttggaacaaggtggtattgacgtcttgtacaaatggcaattggtgtcctctaagttgttggatggtttgtttttgagagccttgtctcaagttgtcaacagaactatcaccgttgaattttacgctcagtttttgggtagagccgatgaattggttgctatcgttaatcaatctttgccagagttgggtttgaagagacaagattgcttggaaatgtcttggttgaacactaccttgttttgggaagatttgccagttggtactccaacttctgttttgttggatagaccatctaagccagagaagttcttcaagtctaaatccgattacgtcaagaagcccattccaaaagagggtattaagaaattgtgggaagccttgttggagtttaacaacaacaatatcgtctacatgcagtggaatccatacggtggtgttatggatactgttccagctgctgctactccatttccacatagaaaaggtaacttgttcgaagtccagtactacacttcttggttggatgctaatgctacaatgggttctttggacatgatgaagaagttgtacgaagttgctgaaccctacgtttcttctaatccaagagaagcctttttgaactacagagacatcgacattggtagcaatccatctaacgaaactaatgttgaagaagccgaaatctacggctctaagtactttgttggtaacttgaagagattgatggaagtcaaggctaagtacgatccagaaaactttttcaagaacgagcaatctattccaccagccagagttaagcaatggtcacatccacaatttgaaaag

SEQ ID NO: 21 - protein, 434 aa, Artificial Sequence
  Synthetic Construct
MRFPSIFTAVLFAASSALAAPVNTTTEDETAQIPAEAVIGYSDLEGDFDVAVLPFSNSTNNGLLFINTTIASIAAKEEGVSLEKREAEAMRKYGLTVDNVVDALIVDVNGKLLNRSTMGEDLFWAIRGGGGGSFGVILSWKINLVDVPEILTVFRVNKTLEQGGIDVLYKWQLVSSKLLDGLFLRALSQVVNRTITVEFYAQFLGRADELVAIVNQSLPELGLKRQDCLEMSWLNTTLFWEDLPVGTPTSVLLDRPSKPEKFFKSKSDYVKKPIPKEGIKKLWEALLEFNNNNIVYMQWNPYGGVMDTVPAAATPFPHRKGNLFEVQYYTSWLDANATMGSLDMMKKLYEVAEPYVSSNPREAFLNYRDIDIGSNPSNETNVEEAEIYGSKYFVGNLKRLMEVKAKYDPENFFKNEQSIPPARVKQWSHPQFEK

SEQ ID NO: 22 - DNA, 1641 bp, Artificial Sequence
  CBS17-A0A1J6KPK0
  CDS (1)..(1641)
atggcctccttgaactctatcatggtgtcttttttcttggtcctgctgttctcttcttcttgttttgctttgtctgataccactccagaaaagttctaccaatgtatctgcaagaactccgatttctctgatccattttctaaggctttcttcactccaaacaccgattctttcaacaccgttttaaactctaccgctcaaaacttgagatgtttgatgccaactgttccaaagccagttttgatttttactccaatggccgaatctcatgttcaagctgctgttatttgtgccaagcaattgaacttgcaattgagagttagatccggtggtcatgattatgaaggtttgtcctacatctccgttatggattctccattcgttatcgttgacttgtccaagttgagagagattgacgttaacatcgaagaaaattctgcttgggctcaagctggtgctactgttggtgaagtttattacagaatctccgagaagtctaagactcatggttttccagctggtttgtgtacctctttaggtattggtggtcatatcactggtggtgcttatggttctatgatgagaaaatttggtttgggtgccgataacgtcattgatgctagaatcgttaatgccaacggtactatcttggacagattgtctatgggtgaagatttgttctgggctattagaggtggtggtggcgcttcttttggtattatcttgtcttggaagttgaagttggttaccgttccatctgttgttactgttttcaccgttccaaaaaccttggaagatggtgctacaaagatcttgtacaaatggcaacaagttgccgataagatcgatgatgatttgttcatgagagtcgttatcaacgtcgttgacaaaaaggataagaagggtgaaagaactgttcaaaccgcttacaactctttgttcttgggtaatgttgacaggttgttgcagatcatgaatgaatcttttccagagttgggtttgacccaaaaagattgcactgaaatgtcctggatcgagtccatcttgtatattgctggtttcccaacaaaaaccccaccagaaattttgttgcaaggtaagccaactttcaagaactacttcaaggctaagtccgacttcatcaaagaacctattccagaaactggtctggatggtatttggaaaagactattggaagaggactccccattgatgatatggaatccatacggtggtatgatggccaacatttctgaatctgaaactccatttccacacagaaagggtgttatcttcaagatccaatacttgactttgtggaccgaaccagatcaagaattggctacaaaacatgttgactggatcagaaagctgtactcttacatgacttcttacgcttctatgtttccaagagaagcctacgttaactacagagatttggacttgggtatgaacaagaatggcaactctaactcctcattcgttcaagctacagtttggggtaacaagtacttcaacaacaatttcaacaggctggtcgaaatcaagactaaggttgatccagagaatttcttcaagttcgaacaatccattccaaccttgccattgactaagaaaagaaagggtaagaagatcaaccat

SEQ ID NO: 23 - protein, 547 aa, Artificial Sequence
  Synthetic Construct
MASLNSIMVSFFLVLLFSSSCFALSDTTPEKFYQCICKNSDFSDPFSKAFFTPNTDSFNTVLNSTAQNLRCLMPTVPKPVLIFTPMAESHVQAAVICAKQLNLQLRVRSGGHDYEGLSYISVMDSPFVIVDLSKLREIDVNIEENSAWAQAGATVGEVYYRISEKSKTHGFPAGLCTSLGIGGHITGGAYGSMMRKFGLGADNVIDARIVNANGTILDRLSMGEDLFWAIRGGGGASFGIILSWKLKLVTVPSVVTVFTVPKTLEDGATKILYKWQQVADKIDDDLFMRVVINVVDKKDKKGERTVQTAYNSLFLGNVDRLLQIMNESFPELGLTQKDCTEMSWIESILYIAGFPTKTPPEILLQGKPTFKNYFKAKSDFIKEPIPETGLDGIWKRLLEEDSPLMIWNPYGGMMANISESETPFPHRKGVIFKIQYLTLWTEPDQELATKHVDWIRKLYSYMTSYASMFPREAYVNYRDLDLGMNKNGNSNSSFVQATVWGNKYFNNNFNRLVEIKTKVDPENFFKFEQSIPTLPLTKKRKGKKINH

SEQ ID NO: 24 - DNA, 1575 bp, Artificial Sequence
  CBS17-A0A1J6KPK0-no signal peptide
  CDS (1)..(1575)
atgttgtctgataccactccagaaaagttctaccaatgtatctgcaagaactccgatttctctgatccattttctaaggctttcttcactccaaacaccgattctttcaacaccgttttaaactctaccgctcaaaacttgagatgtttgatgccaactgttccaaagccagttttgatttttactccaatggccgaatctcatgttcaagctgctgttatttgtgccaagcaattgaacttgcaattgagagttagatccggtggtcatgattatgaaggtttgtcctacatctccgttatggattctccattcgttatcgttgacttgtccaagttgagagagattgacgttaacatcgaagaaaattctgcttgggctcaagctggtgctactgttggtgaagtttattacagaatctccgagaagtctaagactcatggttttccagctggtttgtgtacctctttaggtattggtggtcatatcactggtggtgcttatggttctatgatgagaaaatttggtttgggtgccgataacgtcattgatgctagaatcgttaatgccaacggtactatcttggacagattgtctatgggtgaagatttgttctgggctattagaggtggtggtggcgcttcttttggtattatcttgtcttggaagttgaagttggttaccgttccatctgttgttactgttttcaccgttccaaaaaccttggaagatggtgctacaaagatcttgtacaaatggcaacaagttgccgataagatcgatgatgatttgttcatgagagtcgttatcaacgtcgttgacaaaaaggataagaagggtgaaagaactgttcaaaccgcttacaactctttgttcttgggtaatgttgacaggttgttgcagatcatgaatgaatcttttccagagttgggtttgacccaaaaagattgcactgaaatgtcctggatcgagtccatcttgtatattgctggtttcccaacaaaaaccccaccagaaattttgttgcaaggtaagccaactttcaagaactacttcaaggctaagtccgacttcatcaaagaacctattccagaaactggtctggatggtatttggaaaagactattggaagaggactccccattgatgatatggaatccatacggtggtatgatggccaacatttctgaatctgaaactccatttccacacagaaagggtgttatcttcaagatccaatacttgactttgtggaccgaaccagatcaagaattggctacaaaacatgttgactggatcagaaagctgtactcttacatgacttcttacgcttctatgtttccaagagaagcctacgttaactacagagatttggacttgggtatgaacaagaatggcaactctaactcctcattcgttcaagctacagtttggggtaacaagtacttcaacaacaatttcaacaggctggtcgaaatcaagactaaggttgatccagagaatttcttcaagttcgaacaatccattccaaccttgccattgactaagaaaagaaagggtaagaagatcaaccat

SEQ ID NO: 25 - protein, 525 aa, Artificial Sequence
  Synthetic Construct
MLSDTTPEKFYQCICKNSDFSDPFSKAFFTPNTDSFNTVLNSTAQNLRCLMPTVPKPVLIFTPMAESHVQAAVICAKQLNLQLRVRSGGHDYEGLSYISVMDSPFVIVDLSKLREIDVNIEENSAWAQAGATVGEVYYRISEKSKTHGFPAGLCTSLGIGGHITGGAYGSMMRKFGLGADNVIDARIVNANGTILDRLSMGEDLFWAIRGGGGASFGIILSWKLKLVTVPSVVTVFTVPKTLEDGATKILYKWQQVADKIDDDLFMRVVINVVDKKDKKGERTVQTAYNSLFLGNVDRLLQIMNESFPELGLTQKDCTEMSWIESILYIAGFPTKTPPEILLQGKPTFKNYFKAKSDFIKEPIPETGLDGIWKRLLEEDSPLMIWNPYGGMMANISESETPFPHRKGVIFKIQYLTLWTEPDQELATKHVDWIRKLYSYMTSYASMFPREAYVNYRDLDLGMNKNGNSNSSFVQATVWGNKYFNNNFNRLVEIKTKVDPENFFKFEQSIPTLPLTKKRKGKKINH

SEQ ID NO: 26 - DNA, 1599 bp, Artificial Sequence
  CBS17-A0A1J6KPK0-no signal peptide-strep Tag
atgttgtctgataccactccagaaaagttctaccaatgtatctgcaagaactccgatttctctgatccattttctaaggctttcttcactccaaacaccgattctttcaacaccgttttaaactctaccgctcaaaacttgagatgtttgatgccaactgttccaaagccagttttgatttttactccaatggccgaatctcatgttcaagctgctgttatttgtgccaagcaattgaacttgcaattgagagttagatccggtggtcatgattatgaaggtttgtcctacatctccgttatggattctccattcgttatcgttgacttgtccaagttgagagagattgacgttaacatcgaagaaaattctgcttgggctcaagctggtgctactgttggtgaagtttattacagaatctccgagaagtctaagactcatggttttccagctggtttgtgtacctctttaggtattggtggtcatatcactggtggtgcttatggttctatgatgagaaaatttggtttgggtgccgataacgtcattgatgctagaatcgttaatgccaacggtactatcttggacagattgtctatgggtgaagatttgttctgggctattagaggtggtggtggcgcttcttttggtattatcttgtcttggaagttgaagttggttaccgttccatctgttgttactgttttcaccgttccaaaaaccttggaagatggtgctacaaagatcttgtacaaatggcaacaagttgccgataagatcgatgatgatttgttcatgagagtcgttatcaacgtcgttgacaaaaaggataagaagggtgaaagaactgttcaaaccgcttacaactctttgttcttgggtaatgttgacaggttgttgcagatcatgaatgaatcttttccagagttgggtttgacccaaaaagattgcactgaaatgtcctggatcgagtccatcttgtatattgctggtttcccaacaaaaaccccaccagaaattttgttgcaaggtaagccaactttcaagaactacttcaaggctaagtccgacttcatcaaagaacctattccagaaactggtctggatggtatttggaaaagactattggaagaggactccccattgatgatatggaatccatacggtggtatgatggccaacatttctgaatctgaaactccatttccacacagaaagggtgttatcttcaagatccaatacttgactttgtggaccgaaccagatcaagaattggctacaaaacatgttgactggatcagaaagctgtactcttacatgacttcttacgcttctatgtttccaagagaagcctacgttaactacagagatttggacttgggtatgaacaagaatggcaactctaactcctcattcgttcaagctacagtttggggtaacaagtacttcaacaacaatttcaacaggctggtcgaaatcaagactaaggttgatccagagaatttcttcaagttcgaacaatccattccaaccttgccattgactaagaaaagaaagggtaagaagatcaaccattggtcacatccacaatttgaaaag

SEQ ID NO: 27 - DNA, 1656 bp, Artificial Sequence
  CBS17-A0A1J6KPK0-truncatd alpha factor - no signal peptide-strep Tag
atgagatttccttccatcttcacggctgtgctatttgcagcatcctccgcacttgcaatgttgtctgataccactccagaaaagttctaccaatgtatctgcaagaactccgatttctctgatccattttctaaggctttcttcactccaaacaccgattctttcaacaccgttttaaactctaccgctcaaaacttgagatgtttgatgccaactgttccaaagccagttttgatttttactccaatggccgaatctcatgttcaagctgctgttatttgtgccaagcaattgaacttgcaattgagagttagatccggtggtcatgattatgaaggtttgtcctacatctccgttatggattctccattcgttatcgttgacttgtccaagttgagagagattgacgttaacatcgaagaaaattctgcttgggctcaagctggtgctactgttggtgaagtttattacagaatctccgagaagtctaagactcatggttttccagctggtttgtgtacctctttaggtattggtggtcatatcactggtggtgcttatggttctatgatgagaaaatttggtttgggtgccgataacgtcattgatgctagaatcgttaatgccaacggtactatcttggacagattgtctatgggtgaagatttgttctgggctattagaggtggtggtggcgcttcttttggtattatcttgtcttggaagttgaagttggttaccgttccatctgttgttactgttttcaccgttccaaaaaccttggaagatggtgctacaaagatcttgtacaaatggcaacaagttgccgataagatcgatgatgatttgttcatgagagtcgttatcaacgtcgttgacaaaaaggataagaagggtgaaagaactgttcaaaccgcttacaactctttgttcttgggtaatgttgacaggttgttgcagatcatgaatgaatcttttccagagttgggtttgacccaaaaagattgcactgaaatgtcctggatcgagtccatcttgtatattgctggtttcccaacaaaaaccccaccagaaattttgttgcaaggtaagccaactttcaagaactacttcaaggctaagtccgacttcatcaaagaacctattccagaaactggtctggatggtatttggaaaagactattggaagaggactccccattgatgatatggaatccatacggtggtatgatggccaacatttctgaatctgaaactccatttccacacagaaagggtgttatcttcaagatccaatacttgactttgtggaccgaaccagatcaagaattggctacaaaacatgttgactggatcagaaagctgtactcttacatgacttcttacgcttctatgtttccaagagaagcctacgttaactacagagatttggacttgggtatgaacaagaatggcaactctaactcctcattcgttcaagctacagtttggggtaacaagtacttcaacaacaatttcaacaggctggtcgaaatcaagactaaggttgatccagagaatttcttcaagttcgaacaatccattccaaccttgccattgactaagaaaagaaagggtaagaagatcaaccattggtcacatccacaatttgaaaag

SEQ ID NO: 28 - DNA, 1866 bp, Artificial Sequence
  CBS17-A0A1J6KPK0-full alpha factor - no signal peptide-strep Tag
  CDS (1)..(1866)
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagctatgttgtctgataccactccagaaaagttctaccaatgtatctgcaagaactccgatttctctgatccattttctaaggctttcttcactccaaacaccgattctttcaacaccgttttaaactctaccgctcaaaacttgagatgtttgatgccaactgttccaaagccagttttgatttttactccaatggccgaatctcatgttcaagctgctgttatttgtgccaagcaattgaacttgcaattgagagttagatccggtggtcatgattatgaaggtttgtcctacatctccgttatggattctccattcgttatcgttgacttgtccaagttgagagagattgacgttaacatcgaagaaaattctgcttgggctcaagctggtgctactgttggtgaagtttattacagaatctccgagaagtctaagactcatggttttccagctggtttgtgtacctctttaggtattggtggtcatatcactggtggtgcttatggttctatgatgagaaaatttggtttgggtgccgataacgtcattgatgctagaatcgttaatgccaacggtactatcttggacagattgtctatgggtgaagatttgttctgggctattagaggtggtggtggcgcttcttttggtattatcttgtcttggaagttgaagttggttaccgttccatctgttgttactgttttcaccgttccaaaaaccttggaagatggtgctacaaagatcttgtacaaatggcaacaagttgccgataagatcgatgatgatttgttcatgagagtcgttatcaacgtcgttgacaaaaaggataagaagggtgaaagaactgttcaaaccgcttacaactctttgttcttgggtaatgttgacaggttgttgcagatcatgaatgaatcttttccagagttgggtttgacccaaaaagattgcactgaaatgtcctggatcgagtccatcttgtatattgctggtttcccaacaaaaaccccaccagaaattttgttgcaaggtaagccaactttcaagaactacttcaaggctaagtccgacttcatcaaagaacctattccagaaactggtctggatggtatttggaaaagactattggaagaggactccccattgatgatatggaatccatacggtggtatgatggccaacatttctgaatctgaaactccatttccacacagaaagggtgttatcttcaagatccaatacttgactttgtggaccgaaccagatcaagaattggctacaaaacatgttgactggatcagaaagctgtactcttacatgacttcttacgcttctatgtttccaagagaagcctacgttaactacagagatttggacttgggtatgaacaagaatggcaactctaactcctcattcgttcaagctacagtttggggtaacaagtacttcaacaacaatttcaacaggctggtcgaaatcaagactaaggttgatccagagaatttcttcaagttcgaacaatccattccaaccttgccattgactaagaaaagaaagggtaagaagatcaaccattggtcacatccacaatttgaaaag

SEQ ID NO: 29 - protein, 622 aa, Artificial Sequence
  Synthetic Construct
MRFPSIFTAVLFAASSALAAPVNTTTEDETAQIPAEAVIGYSDLEGDFDVAVLPFSNSTNNGLLFINTTIASIAAKEEGVSLEKREAEAMLSDTTPEKFYQCICKNSDFSDPFSKAFFTPNTDSFNTVLNSTAQNLRCLMPTVPKPVLIFTPMAESHVQAAVICAKQLNLQLRVRSGGHDYEGLSYISVMDSPFVIVDLSKLREIDVNIEENSAWAQAGATVGEVYYRISEKSKTHGFPAGLCTSLGIGGHITGGAYGSMMRKFGLGADNVIDARIVNANGTILDRLSMGEDLFWAIRGGGGASFGIILSWKLKLVTVPSVVTVFTVPKTLEDGATKILYKWQQVADKIDDDLFMRVVINVVDKKDKKGERTVQTAYNSLFLGNVDRLLQIMNESFPELGLTQKDCTEMSWIESILYIAGFPTKTPPEILLQGKPTFKNYFKAKSDFIKEPIPETGLDGIWKRLLEEDSPLMIWNPYGGMMANISESETPFPHRKGVIFKIQYLTLWTEPDQELATKHVDWIRKLYSYMTSYASMFPREAYVNYRDLDLGMNKNGNSNSSFVQATVWGNKYFNNNFNRLVEIKTKVDPENFFKFEQSIPTLPLTKKRKGKKINHWSHPQFEK

SEQ ID NO: 30 - DNA, 1521 bp, Artificial Sequence
  CBS35-M5X864
atgcagatcattatcaccaagagatcctctgcttacttctctgctgttcaatcctctatccaaaacttgatcttcgttaccagaggtacttctagaccagaagctattattaccttgttgcatgattctcacggtgtcttgattagaatcagatctagaggtcatgactacgaaggtcaatcttatgttgctagagccccattcgttatcatcgatttgtttaacttgaggtccatcgacgttgacattgaaaatggttctgcttgggttgaatctggtgctactttgggtgagttgtattacagaattgccgaaaagtctaaggcttacggttttccagctggttcttgtccaactattggtgttggtggtcatatttctggtggtggttttggtactttgttcagaaagtatggtttggctgctgataacgttttggatgctaaaatcgttgatgtcaacggtagagttttggacagaaaacctatgggtgaagaattattctgggctattagaggtggtggtggatcttcttttggtgttattttggcttggaagttgaagttggttccagttccaccatctgttactagacatgaagatttgttcttgcactccgttataggtgttggtaacaaagctggtactaatggtgataagaccattattatcgagttcagctccttgtttttgggtccagttgaaaagttgttgccatccatgcaagataacttctccgaattgtctgttgatagatccgattgcactgaaatgtcctggattgaatctgtcttgtacttcgctttcatcccaagaaatgaatctgaagccttgttgggtagaacccaacaatctaaatctttcgctaagccacaaggtattttctggactcatagaactccaaccatgaacgttaattctccaacctctaagttctgtactacttgtactccatctaagacctacaagagaggtacatctccaaagattgaagttactggtactttcggcactttgaaaacttctacctctgttttcaaggccaagtccgattatgttaacgaacctatttctaaggctggtttggaaggtttgtggcaaactttgatagaagttaaggcctacctgatcttgacattatacggtggtaagatctccgagatttccaactctgaaattcatttcccacacaggtctggtaacttgttcaaaattcagtacatggttacctgggacgactacagagaaaacgaaattggtgaatccctgatgagaaagttgtacgattatatggctccctacgtttctaaatctccaagagctgcttatctgaactacaaggatttggacttaggtagaaacaacgatgttcatacttcttacgctcaagctagtatttggggcttgaagtactttaagaacaacttcagaagattggtccacgttaagactttggttgatccaggtaatttcttcagggacgaacaatctattccatccgttagatcttcccgtaagaag

SEQ ID NO: 31 - DNA, 1545 bp, Artificial Sequence
  CBS35-M5X864-strep Tag
  CDS (1)..(1545)
atgcagatcattatcaccaagagatcctctgcttacttctctgctgttcaatcctctatccaaaacttgatcttcgttaccagaggtacttctagaccagaagctattattaccttgttgcatgattctcacggtgtcttgattagaatcagatctagaggtcatgactacgaaggtcaatcttatgttgctagagccccattcgttatcatcgatttgtttaacttgaggtccatcgacgttgacattgaaaatggttctgcttgggttgaatctggtgctactttgggtgagttgtattacagaattgccgaaaagtctaaggcttacggttttccagctggttcttgtccaactattggtgttggtggtcatatttctggtggtggttttggtactttgttcagaaagtatggtttggctgctgataacgttttggatgctaaaatcgttgatgtcaacggtagagttttggacagaaaacctatgggtgaagaattattctgggctattagaggtggtggtggatcttcttttggtgttattttggcttggaagttgaagttggttccagttccaccatctgttactagacatgaagatttgttcttgcactccgttataggtgttggtaacaaagctggtactaatggtgataagaccattattatcgagttcagctccttgtttttgggtccagttgaaaagttgttgccatccatgcaagataacttctccgaattgtctgttgatagatccgattgcactgaaatgtcctggattgaatctgtcttgtacttcgctttcatcccaagaaatgaatctgaagccttgttgggtagaacccaacaatctaaatctttcgctaagccacaaggtattttctggactcatagaactccaaccatgaacgttaattctccaacctctaagttctgtactacttgtactccatctaagacctacaagagaggtacatctccaaagattgaagttactggtactttcggcactttgaaaacttctacctctgttttcaaggccaagtccgattatgttaacgaacctatttctaaggctggtttggaaggtttgtggcaaactttgatagaagttaaggcctacctgatcttgacattatacggtggtaagatctccgagatttccaactctgaaattcatttcccacacaggtctggtaacttgttcaaaattcagtacatggttacctgggacgactacagagaaaacgaaattggtgaatccctgatgagaaagttgtacgattatatggctccctacgtttctaaatctccaagagctgcttatctgaactacaaggatttggacttaggtagaaacaacgatgttcatacttcttacgctcaagctagtatttggggcttgaagtactttaagaacaacttcagaagattggtccacgttaagactttggttgatccaggtaatttcttcagggacgaacaatctattccatccgttagatcttcccgtaagaagtggtcacatccacaatttgaaaag

SEQ ID NO: 32 - protein, 515 aa, Artificial Sequence
  Synthetic Construct
MQIIITKRSSAYFSAVQSSIQNLIFVTRGTSRPEAIITLLHDSHGVLIRIRSRGHDYEGQSYVARAPFVIIDLFNLRSIDVDIENGSAWVESGATLGELYYRIAEKSKAYGFPAGSCPTIGVGGHISGGGFGTLFRKYGLAADNVLDAKIVDVNGRVLDRKPMGEELFWAIRGGGGSSFGVILAWKLKLVPVPPSVTRHEDLFLHSVIGVGNKAGTNGDKTIIIEFSSLFLGPVEKLLPSMQDNFSELSVDRSDCTEMSWIESVLYFAFIPRNESEALLGRTQQSKSFAKPQGIFWTHRTPTMNVNSPTSKFCTTCTPSKTYKRGTSPKIEVTGTFGTLKTSTSVFKAKSDYVNEPISKAGLEGLWQTLIEVKAYLILTLYGGKISEISNSEIHFPHRSGNLFKIQYMVTWDDYRENEIGESLMRKLYDYMAPYVSKSPRAAYLNYKDLDLGRNNDVHTSYAQASIWGLKYFKNNFRRLVHVKTLVDPGNFFRDEQSIPSVRSSRKKWSHPQFEK

SEQ ID NO: 33 - DNA, 1602 bp, Artificial Sequence
  CBS35-M5X864- truncated alpha factor - strep Tag
  CDS (1)..(1602)
atgagatttccttccatcttcacggctgtgctatttgcagcatcctccgcacttgcaatgcagatcattatcaccaagagatcctctgcttacttctctgctgttcaatcctctatccaaaacttgatcttcgttaccagaggtacttctagaccagaagctattattaccttgttgcatgattctcacggtgtcttgattagaatcagatctagaggtcatgactacgaaggtcaatcttatgttgctagagccccattcgttatcatcgatttgtttaacttgaggtccatcgacgttgacattgaaaatggttctgcttgggttgaatctggtgctactttgggtgagttgtattacagaattgccgaaaagtctaaggcttacggttttccagctggttcttgtccaactattggtgttggtggtcatatttctggtggtggttttggtactttgttcagaaagtatggtttggctgctgataacgttttggatgctaaaatcgttgatgtcaacggtagagttttggacagaaaacctatgggtgaagaattattctgggctattagaggtggtggtggatcttcttttggtgttattttggcttggaagttgaagttggttccagttccaccatctgttactagacatgaagatttgttcttgcactccgttataggtgttggtaacaaagctggtactaatggtgataagaccattattatcgagttcagctccttgtttttgggtccagttgaaaagttgttgccatccatgcaagataacttctccgaattgtctgttgatagatccgattgcactgaaatgtcctggattgaatctgtcttgtacttcgctttcatcccaagaaatgaatctgaagccttgttgggtagaacccaacaatctaaatctttcgctaagccacaaggtattttctggactcatagaactccaaccatgaacgttaattctccaacctctaagttctgtactacttgtactccatctaagacctacaagagaggtacatctccaaagattgaagttactggtactttcggcactttgaaaacttctacctctgttttcaaggccaagtccgattatgttaacgaacctatttctaaggctggtttggaaggtttgtggcaaactttgatagaagttaaggcctacctgatcttgacattatacggtggtaagatctccgagatttccaactctgaaattcatttcccacacaggtctggtaacttgttcaaaattcagtacatggttacctgggacgactacagagaaaacgaaattggtgaatccctgatgagaaagttgtacgattatatggctccctacgtttctaaatctccaagagctgcttatctgaactacaaggatttggacttaggtagaaacaacgatgttcatacttcttacgctcaagctagtatttggggcttgaagtactttaagaacaacttcagaagattggtccacgttaagactttggttgatccaggtaatttcttcagggacgaacaatctattccatccgttagatcttcccgtaagaagtggtcacatccacaatttgaaaag

SEQ ID NO: 34 - protein, 534 aa, Artificial Sequence
  Synthetic Construct
MRFPSIFTAVLFAASSALAMQIIITKRSSAYFSAVQSSIQNLIFVTRGTSRPEAIITLLHDSHGVLIRIRSRGHDYEGQSYVARAPFVIIDLFNLRSIDVDIENGSAWVESGATLGELYYRIAEKSKAYGFPAGSCPTIGVGGHISGGGFGTLFRKYGLAADNVLDAKIVDVNGRVLDRKPMGEELFWAIRGGGGSSFGVILAWKLKLVPVPPSVTRHEDLFLHSVIGVGNKAGTNGDKTIIIEFSSLFLGPVEKLLPSMQDNFSELSVDRSDCTEMSWIESVLYFAFIPRNESEALLGRTQQSKSFAKPQGIFWTHRTPTMNVNSPTSKFCTTCTPSKTYKRGTSPKIEVTGTFGTLKTSTSVFKAKSDYVNEPISKAGLEGLWQTLIEVKAYLILTLYGGKISEISNSEIHFPHRSGNLFKIQYMVTWDDYRENEIGESLMRKLYDYMAPYVSKSPRAAYLNYKDLDLGRNNDVHTSYAQASIWGLKYFKNNFRRLVHVKTLVDPGNFFRDEQSIPSVRSSRKKWSHPQFEK

SEQ ID NO: 35 - DNA, 1812 bp, Artificial Sequence
  CBS35-M5X864- full alpha factor - strep Tag
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagctatgcagatcattatcaccaagagatcctctgcttacttctctgctgttcaatcctctatccaaaacttgatcttcgttaccagaggtacttctagaccagaagctattattaccttgttgcatgattctcacggtgtcttgattagaatcagatctagaggtcatgactacgaaggtcaatcttatgttgctagagccccattcgttatcatcgatttgtttaacttgaggtccatcgacgttgacattgaaaatggttctgcttgggttgaatctggtgctactttgggtgagttgtattacagaattgccgaaaagtctaaggcttacggttttccagctggttcttgtccaactattggtgttggtggtcatatttctggtggtggttttggtactttgttcagaaagtatggtttggctgctgataacgttttggatgctaaaatcgttgatgtcaacggtagagttttggacagaaaacctatgggtgaagaattattctgggctattagaggtggtggtggatcttcttttggtgttattttggcttggaagttgaagttggttccagttccaccatctgttactagacatgaagatttgttcttgcactccgttataggtgttggtaacaaagctggtactaatggtgataagaccattattatcgagttcagctccttgtttttgggtccagttgaaaagttgttgccatccatgcaagataacttctccgaattgtctgttgatagatccgattgcactgaaatgtcctggattgaatctgtcttgtacttcgctttcatcccaagaaatgaatctgaagccttgttgggtagaacccaacaatctaaatctttcgctaagccacaaggtattttctggactcatagaactccaaccatgaacgttaattctccaacctctaagttctgtactacttgtactccatctaagacctacaagagaggtacatctccaaagattgaagttactggtactttcggcactttgaaaacttctacctctgttttcaaggccaagtccgattatgttaacgaacctatttctaaggctggtttggaaggtttgtggcaaactttgatagaagttaaggcctacctgatcttgacattatacggtggtaagatctccgagatttccaactctgaaattcatttcccacacaggtctggtaacttgttcaaaattcagtacatggttacctgggacgactacagagaaaacgaaattggtgaatccctgatgagaaagttgtacgattatatggctccctacgtttctaaatctccaagagctgcttatctgaactacaaggatttggacttaggtagaaacaacgatgttcatacttcttacgctcaagctagtatttggggcttgaagtactttaagaacaacttcagaagattggtccacgttaagactttggttgatccaggtaatttcttcagggacgaacaatctattccatccgttagatcttcccgtaagaagtggtcacatccacaatttgaaaag

SEQ ID NO: 36 - DNA, 1620 bp, Artificial Sequence
  CBS59-O64745
  CDS (1)..(1620)
atgaagttctggtcaagacctttgaccttcttgatcatcatcatctacctgatcatccaacaggttaattcttctccaccatccttgtctattccagaacatttcttgagatgcttggatacccaaccatctgatcatggttctccaaattctagaactgccgttattccaacgaactcttctttttctaccaacttgatgaacggcgtcagaaatttgagattcgcttctgtttctactaggaagccagaagttatagttgctgctgttactgaaacccatattagagctaccatttcttgctgcaagttgttgaacttggaattgagaattagatccggtggtcatgattacgaaggtttctcttatacttctccagttccattcgttatcctggacatgtacaacttcaacaagatcgacattaacatgaaggacgaaaccgtctggattcaatctggtgcttctttgggtcagttgtactacaatattgcctccaagtctaaggttcatgcttttccagctggtgtttgtccaaaagttggtgctggtggtcatttttctggtggtggttttggtaatttgatgaggaaatacggtttgtccatcgatcatatcattgacgcccaaattatggatgctaacggtaaggtttacagaaacagacaagctatgggtgaagatgttttctgggctattagaggtggtggtggcggttcttatggtgttattttggcttggaagattaagttggttagggttccagaaaaggtcaccgtttttaagttggaaagaaccgttagagaaggtgccgttgatttggttcataagtggcaacaagttgccccagttattgatagagatttgttcatcagattggagatcaagcccatcaacagaaagatttctaagggtaagaccatcaaggtgtccttcattggtatgtttttgggtttgccagaacgtttgttgaacatcactaagcaatctttcccagaactgcacttgacaaaagaagattgcatggttaagaagtggatcgagtcatctgttttttgggcaaattacccagaaaaagccccaattgagttgttgttgaaaagagtctctaccaacgagtactactggaagagaacttctgattttgttcaggccccaatttctaaacaaggtttggctaagattttccagaccatgattgatcattctccattgcctagaagagtttggatgcaatggaatccttggggtggtaaaatggctgaaattgcttctgatgctactgcctttgttcacagaggtggtaatgttttcatgatcgaacatttcatgaactggtacagaccaggtgatgaattggaagaaaagttcttggctattgccaggtctttcaaagaagctatggctccatttgtttctaagaatccaagagaagccttcttcaactacagagatgttgatattggtatcactaccccaggttacaatgctacttatgaaggtgctaaagtttacggcgattcttactttaagggtaactacttgaggttggttaagatcaaggctagattcgacagaacgaacttcttcagatctcaacaaggtattccagttttggcc

SEQ ID NO: 37 - protein, 540 aa, Artificial Sequence
  Synthetic Construct
MKFWSRPLTFLIIIIYLIIQQVNSSPPSLSIPEHFLRCLDTQPSDHGSPNSRTAVIPTNSSFSTNLMNGVRNLRFASVSTRKPEVIVAAVTETHIRATISCCKLLNLELRIRSGGHDYEGFSYTSPVPFVILDMYNFNKIDINMKDETVWIQSGASLGQLYYNIASKSKVHAFPAGVCPKVGAGGHFSGGGFGNLMRKYGLSIDHIIDAQIMDANGKVYRNRQAMGEDVFWAIRGGGGGSYGVILAWKIKLVRVPEKVTVFKLERTVREGAVDLVHKWQQVAPVIDRDLFIRLEIKPINRKISKGKTIKVSFIGMFLGLPERLLNITKQSFPELHLTKEDCMVKKWIESSVFWANYPEKAPIELLLKRVSTNEYYWKRTSDFVQAPISKQGLAKIFQTMIDHSPLPRRVWMQWNPWGGKMAEIASDATAFVHRGGNVFMIEHFMNWYRPGDELEEKFLAIARSFKEAMAPFVSKNPREAFFNYRDVDIGITTPGYNATYEGAKVYGDSYFKGNYLRLVKIKARFDRTNFFRSQQGIPVLA

SEQ ID NO: 38 - DNA, 1551 bp, Artificial Sequence
  CBS59-O64745-no signal peptide
  CDS (1)..(1551)
atgtctccaccatccttgtctattccagaacatttcttgagatgcttggatacccaaccatctgatcatggttctccaaattctagaactgccgttattccaacgaactcttctttttctaccaacttgatgaacggcgtcagaaatttgagattcgcttctgtttctactaggaagccagaagttatagttgctgctgttactgaaacccatattagagctaccatttcttgctgcaagttgttgaacttggaattgagaattagatccggtggtcatgattacgaaggtttctcttatacttctccagttccattcgttatcctggacatgtacaacttcaacaagatcgacattaacatgaaggacgaaaccgtctggattcaatctggtgcttctttgggtcagttgtactacaatattgcctccaagtctaaggttcatgcttttccagctggtgtttgtccaaaagttggtgctggtggtcatttttctggtggtggttttggtaatttgatgaggaaatacggtttgtccatcgatcatatcattgacgcccaaattatggatgctaacggtaaggtttacagaaacagacaagctatgggtgaagatgttttctgggctattagaggtggtggtggcggttcttatggtgttattttggcttggaagattaagttggttagggttccagaaaaggtcaccgtttttaagttggaaagaaccgttagagaaggtgccgttgatttggttcataagtggcaacaagttgccccagttattgatagagatttgttcatcagattggagatcaagcccatcaacagaaagatttctaagggtaagaccatcaaggtgtccttcattggtatgtttttgggtttgccagaacgtttgttgaacatcactaagcaatctttcccagaactgcacttgacaaaagaagattgcatggttaagaagtggatcgagtcatctgttttttgggcaaattacccagaaaaagccccaattgagttgttgttgaaaagagtctctaccaacgagtactactggaagagaacttctgattttgttcaggccccaatttctaaacaaggtttggctaagattttccagaccatgattgatcattctccattgcctagaagagtttggatgcaatggaatccttggggtggtaaaatggctgaaattgcttctgatgctactgcctttgttcacagaggtggtaatgttttcatgatcgaacatttcatgaactggtacagaccaggtgatgaattggaagaaaagttcttggctattgccaggtctttcaaagaagctatggctccatttgtttctaagaatccaagagaagccttcttcaactacagagatgttgatattggtatcactaccccaggttacaatgctacttatgaaggtgctaaagtttacggcgattcttactttaagggtaactacttgaggttggttaagatcaaggctagattcgacagaacgaacttcttcagatctcaacaaggtattccagttttggcc

SEQ ID NO: 39 - protein, 517 aa, Artificial Sequence
  Synthetic Construct
MSPPSLSIPEHFLRCLDTQPSDHGSPNSRTAVIPTNSSFSTNLMNGVRNLRFASVSTRKPEVIVAAVTETHIRATISCCKLLNLELRIRSGGHDYEGFSYTSPVPFVILDMYNFNKIDINMKDETVWIQSGASLGQLYYNIASKSKVHAFPAGVCPKVGAGGHFSGGGFGNLMRKYGLSIDHIIDAQIMDANGKVYRNRQAMGEDVFWAIRGGGGGSYGVILAWKIKLVRVPEKVTVFKLERTVREGAVDLVHKWQQVAPVIDRDLFIRLEIKPINRKISKGKTIKVSFIGMFLGLPERLLNITKQSFPELHLTKEDCMVKKWIESSVFWANYPEKAPIELLLKRVSTNEYYWKRTSDFVQAPISKQGLAKIFQTMIDHSPLPRRVWMQWNPWGGKMAEIASDATAFVHRGGNVFMIEHFMNWYRPGDELEEKFLAIARSFKEAMAPFVSKNPREAFFNYRDVDIGITTPGYNATYEGAKVYGDSYFKGNYLRLVKIKARFDRTNFFRSQQGIPVLA

SEQ ID NO: 40 - DNA, 1575 bp, Artificial Sequence
  CBS59-O64745-no signal peptide-strep Tag
  CDS (1)..(1575)
atgtctccaccatccttgtctattccagaacatttcttgagatgcttggatacccaaccatctgatcatggttctccaaattctagaactgccgttattccaacgaactcttctttttctaccaacttgatgaacggcgtcagaaatttgagattcgcttctgtttctactaggaagccagaagttatagttgctgctgttactgaaacccatattagagctaccatttcttgctgcaagttgttgaacttggaattgagaattagatccggtggtcatgattacgaaggtttctcttatacttctccagttccattcgttatcctggacatgtacaacttcaacaagatcgacattaacatgaaggacgaaaccgtctggattcaatctggtgcttctttgggtcagttgtactacaatattgcctccaagtctaaggttcatgcttttccagctggtgtttgtccaaaagttggtgctggtggtcatttttctggtggtggttttggtaatttgatgaggaaatacggtttgtccatcgatcatatcattgacgcccaaattatggatgctaacggtaaggtttacagaaacagacaagctatgggtgaagatgttttctgggctattagaggtggtggtggcggttcttatggtgttattttggcttggaagattaagttggttagggttccagaaaaggtcaccgtttttaagttggaaagaaccgttagagaaggtgccgttgatttggttcataagtggcaacaagttgccccagttattgatagagatttgttcatcagattggagatcaagcccatcaacagaaagatttctaagggtaagaccatcaaggtgtccttcattggtatgtttttgggtttgccagaacgtttgttgaacatcactaagcaatctttcccagaactgcacttgacaaaagaagattgcatggttaagaagtggatcgagtcatctgttttttgggcaaattacccagaaaaagccccaattgagttgttgttgaaaagagtctctaccaacgagtactactggaagagaacttctgattttgttcaggccccaatttctaaacaaggtttggctaagattttccagaccatgattgatcattctccattgcctagaagagtttggatgcaatggaatccttggggtggtaaaatggctgaaattgcttctgatgctactgcctttgttcacagaggtggtaatgttttcatgatcgaacatttcatgaactggtacagaccaggtgatgaattggaagaaaagttcttggctattgccaggtctttcaaagaagctatggctccatttgtttctaagaatccaagagaagccttcttcaactacagagatgttgatattggtatcactaccccaggttacaatgctacttatgaaggtgctaaagtttacggcgattcttactttaagggtaactacttgaggttggttaagatcaaggctagattcgacagaacgaacttcttcagatctcaacaaggtattccagttttggcctggtcacatccacaatttgaaaag

SEQ ID NO: 41 - protein, 525 aa, Artificial Sequence
  Synthetic Construct
MSPPSLSIPEHFLRCLDTQPSDHGSPNSRTAVIPTNSSFSTNLMNGVRNLRFASVSTRKPEVIVAAVTETHIRATISCCKLLNLELRIRSGGHDYEGFSYTSPVPFVILDMYNFNKIDINMKDETVWIQSGASLGQLYYNIASKSKVHAFPAGVCPKVGAGGHFSGGGFGNLMRKYGLSIDHIIDAQIMDANGKVYRNRQAMGEDVFWAIRGGGGGSYGVILAWKIKLVRVPEKVTVFKLERTVREGAVDLVHKWQQVAPVIDRDLFIRLEIKPINRKISKGKTIKVSFIGMFLGLPERLLNITKQSFPELHLTKEDCMVKKWIESSVFWANYPEKAPIELLLKRVSTNEYYWKRTSDFVQAPISKQGLAKIFQTMIDHSPLPRRVWMQWNPWGGKMAEIASDATAFVHRGGNVFMIEHFMNWYRPGDELEEKFLAIARSFKEAMAPFVSKNPREAFFNYRDVDIGITTPGYNATYEGAKVYGDSYFKGNYLRLVKIKARFDRTNFFRSQQGIPVLAWSHPQFEK

SEQ ID NO: 42 - DNA, 1632 bp, Artificial Sequence
  CBS59-O64745- truncated alpha factor -no signal peptide-strep Tag
  CDS (1)..(1632)
atgagatttccttccatcttcacggctgtgctatttgcagcatcctccgcacttgcaatgtctccaccatccttgtctattccagaacatttcttgagatgcttggatacccaaccatctgatcatggttctccaaattctagaactgccgttattccaacgaactcttctttttctaccaacttgatgaacggcgtcagaaatttgagattcgcttctgtttctactaggaagccagaagttatagttgctgctgttactgaaacccatattagagctaccatttcttgctgcaagttgttgaacttggaattgagaattagatccggtggtcatgattacgaaggtttctcttatacttctccagttccattcgttatcctggacatgtacaacttcaacaagatcgacattaacatgaaggacgaaaccgtctggattcaatctggtgcttctttgggtcagttgtactacaatattgcctccaagtctaaggttcatgcttttccagctggtgtttgtccaaaagttggtgctggtggtcatttttctggtggtggttttggtaatttgatgaggaaatacggtttgtccatcgatcatatcattgacgcccaaattatggatgctaacggtaaggtttacagaaacagacaagctatgggtgaagatgttttctgggctattagaggtggtggtggcggttcttatggtgttattttggcttggaagattaagttggttagggttccagaaaaggtcaccgtttttaagttggaaagaaccgttagagaaggtgccgttgatttggttcataagtggcaacaagttgccccagttattgatagagatttgttcatcagattggagatcaagcccatcaacagaaagatttctaagggtaagaccatcaaggtgtccttcattggtatgtttttgggtttgccagaacgtttgttgaacatcactaagcaatctttcccagaactgcacttgacaaaagaagattgcatggttaagaagtggatcgagtcatctgttttttgggcaaattacccagaaaaagccccaattgagttgttgttgaaaagagtctctaccaacgagtactactggaagagaacttctgattttgttcaggccccaatttctaaacaaggtttggctaagattttccagaccatgattgatcattctccattgcctagaagagtttggatgcaatggaatccttggggtggtaaaatggctgaaattgcttctgatgctactgcctttgttcacagaggtggtaatgttttcatgatcgaacatttcatgaactggtacagaccaggtgatgaattggaagaaaagttcttggctattgccaggtctttcaaagaagctatggctccatttgtttctaagaatccaagagaagccttcttcaactacagagatgttgatattggtatcactaccccaggttacaatgctacttatgaaggtgctaaagtttacggcgattcttactttaagggtaactacttgaggttggttaagatcaaggctagattcgacagaacgaacttcttcagatctcaacaaggtattccagttttggcctggtcacatccacaatttgaaaag

SEQ ID NO: 43 - protein, 544 aa, Artificial Sequence
  Synthetic Construct
MRFPSIFTAVLFAASSALAMSPPSLSIPEHFLRCLDTQPSDHGSPNSRTAVIPTNSSFSTNLMNGVRNLRFASVSTRKPEVIVAAVTETHIRATISCCKLLNLELRIRSGGHDYEGFSYTSPVPFVILDMYNFNKIDINMKDETVWIQSGASLGQLYYNIASKSKVHAFPAGVCPKVGAGGHFSGGGFGNLMRKYGLSIDHIIDAQIMDANGKVYRNRQAMGEDVFWAIRGGGGGSYGVILAWKIKLVRVPEKVTVFKLERTVREGAVDLVHKWQQVAPVIDRDLFIRLEIKPINRKISKGKTIKVSFIGMFLGLPERLLNITKQSFPELHLTKEDCMVKKWIESSVFWANYPEKAPIELLLKRVSTNEYYWKRTSDFVQAPISKQGLAKIFQTMIDHSPLPRRVWMQWNPWGGKMAEIASDATAFVHRGGNVFMIEHFMNWYRPGDELEEKFLAIARSFKEAMAPFVSKNPREAFFNYRDVDIGITTPGYNATYEGAKVYGDSYFKGNYLRLVKIKARFDRTNFFRSQQGIPVLAWSHPQFEK

SEQ ID NO: 44 - DNA, 1842 bp, Artificial Sequence
  CBS59-O64745-full alpha factor-no signal peptide-strep Tag
  CDS (1)..(1842)
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagctatgtctccaccatccttgtctattccagaacatttcttgagatgcttggatacccaaccatctgatcatggttctccaaattctagaactgccgttattccaacgaactcttctttttctaccaacttgatgaacggcgtcagaaatttgagattcgcttctgtttctactaggaagccagaagttatagttgctgctgttactgaaacccatattagagctaccatttcttgctgcaagttgttgaacttggaattgagaattagatccggtggtcatgattacgaaggtttctcttatacttctccagttccattcgttatcctggacatgtacaacttcaacaagatcgacattaacatgaaggacgaaaccgtctggattcaatctggtgcttctttgggtcagttgtactacaatattgcctccaagtctaaggttcatgcttttccagctggtgtttgtccaaaagttggtgctggtggtcatttttctggtggtggttttggtaatttgatgaggaaatacggtttgtccatcgatcatatcattgacgcccaaattatggatgctaacggtaaggtttacagaaacagacaagctatgggtgaagatgttttctgggctattagaggtggtggtggcggttcttatggtgttattttggcttggaagattaagttggttagggttccagaaaaggtcaccgtttttaagttggaaagaaccgttagagaaggtgccgttgatttggttcataagtggcaacaagttgccccagttattgatagagatttgttcatcagattggagatcaagcccatcaacagaaagatttctaagggtaagaccatcaaggtgtccttcattggtatgtttttgggtttgccagaacgtttgttgaacatcactaagcaatctttcccagaactgcacttgacaaaagaagattgcatggttaagaagtggatcgagtcatctgttttttgggcaaattacccagaaaaagccccaattgagttgttgttgaaaagagtctctaccaacgagtactactggaagagaacttctgattttgttcaggccccaatttctaaacaaggtttggctaagattttccagaccatgattgatcattctccattgcctagaagagtttggatgcaatggaatccttggggtggtaaaatggctgaaattgcttctgatgctactgcctttgttcacagaggtggtaatgttttcatgatcgaacatttcatgaactggtacagaccaggtgatgaattggaagaaaagttcttggctattgccaggtctttcaaagaagctatggctccatttgtttctaagaatccaagagaagccttcttcaactacagagatgttgatattggtatcactaccccaggttacaatgctacttatgaaggtgctaaagtttacggcgattcttactttaagggtaactacttgaggttggttaagatcaaggctagattcgacagaacgaacttcttcagatctcaacaaggtattccagttttggcctggtcacatccacaatttgaaaag

SEQ ID NO: 45 - protein, 614 aa, Artificial Sequence
  Synthetic Construct
MRFPSIFTAVLFAASSALAAPVNTTTEDETAQIPAEAVIGYSDLEGDFDVAVLPFSNSTNNGLLFINTTIASIAAKEEGVSLEKREAEAMSPPSLSIPEHFLRCLDTQPSDHGSPNSRTAVIPTNSSFSTNLMNGVRNLRFASVSTRKPEVIVAAVTETHIRATISCCKLLNLELRIRSGGHDYEGFSYTSPVPFVILDMYNFNKIDINMKDETVWIQSGASLGQLYYNIASKSKVHAFPAGVCPKVGAGGHFSGGGFGNLMRKYGLSIDHIIDAQIMDANGKVYRNRQAMGEDVFWAIRGGGGGSYGVILAWKIKLVRVPEKVTVFKLERTVREGAVDLVHKWQQVAPVIDRDLFIRLEIKPINRKISKGKTIKVSFIGMFLGLPERLLNITKQSFPELHLTKEDCMVKKWIESSVFWANYPEKAPIELLLKRVSTNEYYWKRTSDFVQAPISKQGLAKIFQTMIDHSPLPRRVWMQWNPWGGKMAEIASDATAFVHRGGNVFMIEHFMNWYRPGDELEEKFLAIARSFKEAMAPFVSKNPREAFFNYRDVDIGITTPGYNATYEGAKVYGDSYFKGNYLRLVKIKARFDRTNFFRSQQGIPVLAWSHPQFEK

SEQ ID NO: 46 - DNA, 1605 bp, Artificial Sequence
  CBS69-P93479
  CDS (1)..(1605)
atgatgtgcagatctttgaccttgaggttcttcttgttcatcgttttgttgcaaacctgtgttagaggtggtgatgttaacgataacttgttgtcctcttgcttgaactctcatggtgttcataacttcactactttgtctaccgataccaactccgattacttcaagttgttgcatgcttctatgcaaaaccctttgtttgctaagccaaccgtttctaagccatcttttatcgttatgccaggctccaaagaagaattgtcatctactgttcattgctgcactagagaatcttggaccattagattgagatctggtggtcattcttacgagggtttgtcttatactgctgatactccattcgttatcgtcgacatgatgaacttgaacagaatctccatcgatgtcttgtctgaaactgcttgggttgaatctggtgctactttgggtgaactgtattatgctattgctcaatccactgataccttgggttttactgctggttggtgtccaactgttggttcaggtggtcatatttctggtggtggttttggtatgatgtctagaaagtatggtttggctgctgataacgttgttgatgccattttgattgattccaacggtgctatcttggacagagaaaaaatgggtgatgatgttttctgggctattagaggcggtggtggtggcgtttggggtgcaatctatgcttggaaaatcaagttattgccagtgccagaaaagttgaccgttttcagagttactaagaacgtcggtattgaagatgcctcttctttgttgcacaaatggcaatatgttgccgatgaattggatgaggatttcaccgtttctgttttaggtggtgttaatggtaatgatgcctggttgatgttcttgggtttacatttgggtagaaaggatgctgccaagaccattattgacgaaaagtttccagaattgggcctagtcgacaaagaatttcaagaaatgtcttggggtgaatcgatggcttttttgtctggtttggataccatctctgaactgaacaacagattcttgaagttcgacgaaagagctttcaagaccaaggttgatttcaccaaagtttccgttccattgaacgtttttagacacgctttggaaatgttgtctgaacaaccaggtggtttcattgctttgaatggtttcggtggtaagatgtccgaaatttctactgactttaccccatttccacacagaaaaggtacgaagttgatgtttgagtacattattgcctggaaccaggacgaagaatctaagattggtgaattttctgaatggctggccaagttctatgattacttggaaccattcgtttccaaagaacctagagttggttacgttaaccacatcgatttggatattggtggtatcgattggaggaacaaatcttctactaccaacgctgttgaaattgctagaaactggggtgaaagatacttcagctctaactacgaaagattggttaaggccaagactttgatcgatccaaacaacgttttcaaccatccacaatctattccaccaatgatgaagtttgaagagatctacatgctgaaagaattg

SEQ ID NO: 47 - protein, 535 aa, Artificial Sequence
  Synthetic Construct
MMCRSLTLRFFLFIVLLQTCVRGGDVNDNLLSSCLNSHGVHNFTTLSTDTNSDYFKLLHASMQNPLFAKPTVSKPSFIVMPGSKEELSSTVHCCTRESWTIRLRSGGHSYEGLSYTADTPFVIVDMMNLNRISIDVLSETAWVESGATLGELYYAIAQSTDTLGFTAGWCPTVGSGGHISGGGFGMMSRKYGLAADNVVDAILIDSNGAILDREKMGDDVFWAIRGGGGGVWGAIYAWKIKLLPVPEKLTVFRVTKNVGIEDASSLLHKWQYVADELDEDFTVSVLGGVNGNDAWLMFLGLHLGRKDAAKTIIDEKFPELGLVDKEFQEMSWGESMAFLSGLDTISELNNRFLKFDERAFKTKVDFTKVSVPLNVFRHALEMLSEQPGGFIALNGFGGKMSEISTDFTPFPHRKGTKLMFEYIIAWNQDEESKIGEFSEWLAKFYDYLEPFVSKEPRVGYVNHIDLDIGGIDWRNKSSTTNAVEIARNWGERYFSSNYERLVKAKTLIDPNNVFNHPQSIPPMMKFEEIYMLKEL

SEQ ID NO: 48 - DNA, 1539 bp, Artificial Sequence
  CBS69-P93479-no signal peptide
  CDS (1)..(1539)
atgggtgatgttaacgataacttgttgtcctcttgcttgaactctcatggtgttcataacttcactactttgtctaccgataccaactccgattacttcaagttgttgcatgcttctatgcaaaaccctttgtttgctaagccaaccgtttctaagccatcttttatcgttatgccaggctccaaagaagaattgtcatctactgttcattgctgcactagagaatcttggaccattagattgagatctggtggtcattcttacgagggtttgtcttatactgctgatactccattcgttatcgtcgacatgatgaacttgaacagaatctccatcgatgtcttgtctgaaactgcttgggttgaatctggtgctactttgggtgaactgtattatgctattgctcaatccactgataccttgggttttactgctggttggtgtccaactgttggttcaggtggtcatatttctggtggtggttttggtatgatgtctagaaagtatggtttggctgctgataacgttgttgatgccattttgattgattccaacggtgctatcttggacagagaaaaaatgggtgatgatgttttctgggctattagaggcggtggtggtggcgtttggggtgcaatctatgcttggaaaatcaagttattgccagtgccagaaaagttgaccgttttcagagttactaagaacgtcggtattgaagatgcctcttctttgttgcacaaatggcaatatgttgccgatgaattggatgaggatttcaccgtttctgttttaggtggtgttaatggtaatgatgcctggttgatgttcttgggtttacatttgggtagaaaggatgctgccaagaccattattgacgaaaagtttccagaattgggcctagtcgacaaagaatttcaagaaatgtcttggggtgaatcgatggcttttttgtctggtttggataccatctctgaactgaacaacagattcttgaagttcgacgaaagagctttcaagaccaaggttgatttcaccaaagtttccgttccattgaacgtttttagacacgctttggaaatgttgtctgaacaaccaggtggtttcattgctttgaatggtttcggtggtaagatgtccgaaatttctactgactttaccccatttccacacagaaaaggtacgaagttgatgtttgagtacattattgcctggaaccaggacgaagaatctaagattggtgaattttctgaatggctggccaagttctatgattacttggaaccattcgtttccaaagaacctagagttggttacgttaaccacatcgatttggatattggtggtatcgattggaggaacaaatcttctactaccaacgctgttgaaattgctagaaactggggtgaaagatacttcagctctaactacgaaagattggttaaggccaagactttgatcgatccaaacaacgttttcaaccatccacaatctattccaccaatgatgaagtttgaagagatctacatgctgaaagaattg

SEQ ID NO: 49 - protein, 513 aa, Artificial Sequence
  Synthetic Construct
MGDVNDNLLSSCLNSHGVHNFTTLSTDTNSDYFKLLHASMQNPLFAKPTVSKPSFIVMPGSKEELSSTVHCCTRESWTIRLRSGGHSYEGLSYTADTPFVIVDMMNLNRISIDVLSETAWVESGATLGELYYAIAQSTDTLGFTAGWCPTVGSGGHISGGGFGMMSRKYGLAADNVVDAILIDSNGAILDREKMGDDVFWAIRGGGGGVWGAIYAWKIKLLPVPEKLTVFRVTKNVGIEDASSLLHKWQYVADELDEDFTVSVLGGVNGNDAWLMFLGLHLGRKDAAKTIIDEKFPELGLVDKEFQEMSWGESMAFLSGLDTISELNNRFLKFDERAFKTKVDFTKVSVPLNVFRHALEMLSEQPGGFIALNGFGGKMSEISTDFTPFPHRKGTKLMFEYIIAWNQDEESKIGEFSEWLAKFYDYLEPFVSKEPRVGYVNHIDLDIGGIDWRNKSSTTNAVEIARNWGERYFSSNYERLVKAKTLIDPNNVFNHPQSIPPMMKFEEIYMLKEL

SEQ ID NO: 50 - DNA, 1563 bp, Artificial Sequence
  CBS69-P93479-no signal peptide-strep Tag
  CDS (1)..(1563)
atgggtgatgttaacgataacttgttgtcctcttgcttgaactctcatggtgttcataacttcactactttgtctaccgataccaactccgattacttcaagttgttgcatgcttctatgcaaaaccctttgtttgctaagccaaccgtttctaagccatcttttatcgttatgccaggctccaaagaagaattgtcatctactgttcattgctgcactagagaatcttggaccattagattgagatctggtggtcattcttacgagggtttgtcttatactgctgatactccattcgttatcgtcgacatgatgaacttgaacagaatctccatcgatgtcttgtctgaaactgcttgggttgaatctggtgctactttgggtgaactgtattatgctattgctcaatccactgataccttgggttttactgctggttggtgtccaactgttggttcaggtggtcatatttctggtggtggttttggtatgatgtctagaaagtatggtttggctgctgataacgttgttgatgccattttgattgattccaacggtgctatcttggacagagaaaaaatgggtgatgatgttttctgggctattagaggcggtggtggtggcgtttggggtgcaatctatgcttggaaaatcaagttattgccagtgccagaaaagttgaccgttttcagagttactaagaacgtcggtattgaagatgcctcttctttgttgcacaaatggcaatatgttgccgatgaattggatgaggatttcaccgtttctgttttaggtggtgttaatggtaatgatgcctggttgatgttcttgggtttacatttgggtagaaaggatgctgccaagaccattattgacgaaaagtttccagaattgggcctagtcgacaaagaatttcaagaaatgtcttggggtgaatcgatggcttttttgtctggtttggataccatctctgaactgaacaacagattcttgaagttcgacgaaagagctttcaagaccaaggttgatttcaccaaagtttccgttccattgaacgtttttagacacgctttggaaatgttgtctgaacaaccaggtggtttcattgctttgaatggtttcggtggtaagatgtccgaaatttctactgactttaccccatttccacacagaaaaggtacgaagttgatgtttgagtacattattgcctggaaccaggacgaagaatctaagattggtgaattttctgaatggctggccaagttctatgattacttggaaccattcgtttccaaagaacctagagttggttacgttaaccacatcgatttggatattggtggtatcgattggaggaacaaatcttctactaccaacgctgttgaaattgctagaaactggggtgaaagatacttcagctctaactacgaaagattggttaaggccaagactttgatcgatccaaacaacgttttcaaccatccacaatctattccaccaatgatgaagtttgaagagatctacatgctgaaagaattgtggtcacatccacaatttgaaaag

SEQ ID NO: 51 - protein, 521 aa, Artificial Sequence
  Synthetic Construct
MGDVNDNLLSSCLNSHGVHNFTTLSTDTNSDYFKLLHASMQNPLFAKPTVSKPSFIVMPGSKEELSSTVHCCTRESWTIRLRSGGHSYEGLSYTADTPFVIVDMMNLNRISIDVLSETAWVESGATLGELYYAIAQSTDTLGFTAGWCPTVGSGGHISGGGFGMMSRKYGLAADNVVDAILIDSNGAILDREKMGDDVFWAIRGGGGGVWGAIYAWKIKLLPVPEKLTVFRVTKNVGIEDASSLLHKWQYVADELDEDFTVSVLGGVNGNDAWLMFLGLHLGRKDAAKTIIDEKFPELGLVDKEFQEMSWGESMAFLSGLDTISELNNRFLKFDERAFKTKVDFTKVSVPLNVFRHALEMLSEQPGGFIALNGFGGKMSEISTDFTPFPHRKGTKLMFEYIIAWNQDEESKIGEFSEWLAKFYDYLEPFVSKEPRVGYVNHIDLDIGGIDWRNKSSTTNAVEIARNWGERYFSSNYERLVKAKTLIDPNNVFNHPQSIPPMMKFEEIYMLKELWSHPQFEK

SEQ ID NO: 52 - DNA, 1620 bp, Artificial Sequence
  CBS69-P93479- truncated alpha factor -no signal peptide-strep Tag
  CDS (1)..(1620)
atgagatttccttccatcttcacggctgtgctatttgcagcatcctccgcacttgcaatgggtgatgttaacgataacttgttgtcctcttgcttgaactctcatggtgttcataacttcactactttgtctaccgataccaactccgattacttcaagttgttgcatgcttctatgcaaaaccctttgtttgctaagccaaccgtttctaagccatcttttatcgttatgccaggctccaaagaagaattgtcatctactgttcattgctgcactagagaatcttggaccattagattgagatctggtggtcattcttacgagggtttgtcttatactgctgatactccattcgttatcgtcgacatgatgaacttgaacagaatctccatcgatgtcttgtctgaaactgcttgggttgaatctggtgctactttgggtgaactgtattatgctattgctcaatccactgataccttgggttttactgctggttggtgtccaactgttggttcaggtggtcatatttctggtggtggttttggtatgatgtctagaaagtatggtttggctgctgataacgttgttgatgccattttgattgattccaacggtgctatcttggacagagaaaaaatgggtgatgatgttttctgggctattagaggcggtggtggtggcgtttggggtgcaatctatgcttggaaaatcaagttattgccagtgccagaaaagttgaccgttttcagagttactaagaacgtcggtattgaagatgcctcttctttgttgcacaaatggcaatatgttgccgatgaattggatgaggatttcaccgtttctgttttaggtggtgttaatggtaatgatgcctggttgatgttcttgggtttacatttgggtagaaaggatgctgccaagaccattattgacgaaaagtttccagaattgggcctagtcgacaaagaatttcaagaaatgtcttggggtgaatcgatggcttttttgtctggtttggataccatctctgaactgaacaacagattcttgaagttcgacgaaagagctttcaagaccaaggttgatttcaccaaagtttccgttccattgaacgtttttagacacgctttggaaatgttgtctgaacaaccaggtggtttcattgctttgaatggtttcggtggtaagatgtccgaaatttctactgactttaccccatttccacacagaaaaggtacgaagttgatgtttgagtacattattgcctggaaccaggacgaagaatctaagattggtgaattttctgaatggctggccaagttctatgattacttggaaccattcgtttccaaagaacctagagttggttacgttaaccacatcgatttggatattggtggtatcgattggaggaacaaatcttctactaccaacgctgttgaaattgctagaaactggggtgaaagatacttcagctctaactacgaaagattggttaaggccaagactttgatcgatccaaacaacgttttcaaccatccacaatctattccaccaatgatgaagtttgaagagatctacatgctgaaagaattgtggtcacatccacaatttgaaaag

SEQ ID NO: 53 - protein, 540 aa, Artificial Sequence
  Synthetic Construct
MRFPSIFTAVLFAASSALAMGDVNDNLLSSCLNSHGVHNFTTLSTDTNSDYFKLLHASMQNPLFAKPTVSKPSFIVMPGSKEELSSTVHCCTRESWTIRLRSGGHSYEGLSYTADTPFVIVDMMNLNRISIDVLSETAWVESGATLGELYYAIAQSTDTLGFTAGWCPTVGSGGHISGGGFGMMSRKYGLAADNVVDAILIDSNGAILDREKMGDDVFWAIRGGGGGVWGAIYAWKIKLLPVPEKLTVFRVTKNVGIEDASSLLHKWQYVADELDEDFTVSVLGGVNGNDAWLMFLGLHLGRKDAAKTIIDEKFPELGLVDKEFQEMSWGESMAFLSGLDTISELNNRFLKFDERAFKTKVDFTKVSVPLNVFRHALEMLSEQPGGFIALNGFGGKMSEISTDFTPFPHRKGTKLMFEYIIAWNQDEESKIGEFSEWLAKFYDYLEPFVSKEPRVGYVNHIDLDIGGIDWRNKSSTTNAVEIARNWGERYFSSNYERLVKAKTLIDPNNVFNHPQSIPPMMKFEEIYMLKELWSHPQFEK

SEQ ID NO: 54 - DNA, 1830 bp, Artificial Sequence
  CBS69-P93479-full alpha factor -no signal peptide-strep Tag
  CDS (1)..(1830)
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagctatgggtgatgttaacgataacttgttgtcctcttgcttgaactctcatggtgttcataacttcactactttgtctaccgataccaactccgattacttcaagttgttgcatgcttctatgcaaaaccctttgtttgctaagccaaccgtttctaagccatcttttatcgttatgccaggctccaaagaagaattgtcatctactgttcattgctgcactagagaatcttggaccattagattgagatctggtggtcattcttacgagggtttgtcttatactgctgatactccattcgttatcgtcgacatgatgaacttgaacagaatctccatcgatgtcttgtctgaaactgcttgggttgaatctggtgctactttgggtgaactgtattatgctattgctcaatccactgataccttgggttttactgctggttggtgtccaactgttggttcaggtggtcatatttctggtggtggttttggtatgatgtctagaaagtatggtttggctgctgataacgttgttgatgccattttgattgattccaacggtgctatcttggacagagaaaaaatgggtgatgatgttttctgggctattagaggcggtggtggtggcgtttggggtgcaatctatgcttggaaaatcaagttattgccagtgccagaaaagttgaccgttttcagagttactaagaacgtcggtattgaagatgcctcttctttgttgcacaaatggcaatatgttgccgatgaattggatgaggatttcaccgtttctgttttaggtggtgttaatggtaatgatgcctggttgatgttcttgggtttacatttgggtagaaaggatgctgccaagaccattattgacgaaaagtttccagaattgggcctagtcgacaaagaatttcaagaaatgtcttggggtgaatcgatggcttttttgtctggtttggataccatctctgaactgaacaacagattcttgaagttcgacgaaagagctttcaagaccaaggttgatttcaccaaagtttccgttccattgaacgtttttagacacgctttggaaatgttgtctgaacaaccaggtggtttcattgctttgaatggtttcggtggtaagatgtccgaaatttctactgactttaccccatttccacacagaaaaggtacgaagttgatgtttgagtacattattgcctggaaccaggacgaagaatctaagattggtgaattttctgaatggctggccaagttctatgattacttggaaccattcgtttccaaagaacctagagttggttacgttaaccacatcgatttggatattggtggtatcgattggaggaacaaatcttctactaccaacgctgttgaaattgctagaaactggggtgaaagatacttcagctctaactacgaaagattggttaaggccaagactttgatcgatccaaacaacgttttcaaccatccacaatctattccaccaatgatgaagtttgaagagatctacatgctgaaagaattgtggtcacatccacaatttgaaaag

SEQ ID NO: 55 - protein, 610 aa, Artificial Sequence
  Synthetic Construct
MRFPSIFTAVLFAASSALAAPVNTTTEDETAQIPAEAVIGYSDLEGDFDVAVLPFSNSTNNGLLFINTTIASIAAKEEGVSLEKREAEAMGDVNDNLLSSCLNSHGVHNFTTLSTDTNSDYFKLLHASMQNPLFAKPTVSKPSFIVMPGSKEELSSTVHCCTRESWTIRLRSGGHSYEGLSYTADTPFVIVDMMNLNRISIDVLSETAWVESGATLGELYYAIAQSTDTLGFTAGWCPTVGSGGHISGGGFGMMSRKYGLAADNVVDAILIDSNGAILDREKMGDDVFWAIRGGGGGVWGAIYAWKIKLLPVPEKLTVFRVTKNVGIEDASSLLHKWQYVADELDEDFTVSVLGGVNGNDAWLMFLGLHLGRKDAAKTIIDEKFPELGLVDKEFQEMSWGESMAFLSGLDTISELNNRFLKFDERAFKTKVDFTKVSVPLNVFRHALEMLSEQPGGFIALNGFGGKMSEISTDFTPFPHRKGTKLMFEYIIAWNQDEESKIGEFSEWLAKFYDYLEPFVSKEPRVGYVNHIDLDIGGIDWRNKSSTTNAVEIARNWGERYFSSNYERLVKAKTLIDPNNVFNHPQSIPPMMKFEEIYMLKELWSHPQFEK

SEQ ID NO: 56 - DNA, 1611 bp, Artificial Sequence
  CBS86-A0A1U8G0D2
  CDS (1)..(1611)
atgatgggttccttgcaaatcttgttcgtcttgttgttctccctggttttgattaagtgctactctcaagaggatttcttggagtgtttgtccaagtactctaagtccaacgttgaacaaaacgtttacactccaacttctccaacctactcctctattttggaatacgctcaaaagaacccaagatgggttaattcttctcacccaaactttattgcctcgccaagaaaagaatctgacatcaagccaattatcttgtgcgctaagaaattgggcttgcagattaagattaagtccggtggtcatgattacgagggtatttcttacagatctaagtccccattcgttatgttggacttgtctaacttgaacaagatcgagatcaactggaagaaagaaaccgtttgggttcaaactggtgctactttgggtcaactgtattatgctattgccaacaagtctaacgttcatggttttccaggtggtgtttgtttctctattggtactggtggtattatttctggtggtggtataggtactatgatgagaaaatttggtgttgccgctgataacgttgttgatgctagagttatggatgtcaacggtaagatcttggacaagaaaaagatgaaggaagatttgttctgggccattagaggtggtggtggcgcttcttttggtgttattttggcttggaaattgaagttggttagggttccagaaaaggtcactgtttttaacgtctacaaaaagttggaaggcaaccagaacttgttgcaaaagtgggaaaacattgctcatcaattgaccgacaagttgttgatcagagtcatcattcaaaacgacggtactggtaaggataagtacatcgaagttatcttccaagccttgttcttgggtttagttgatgaattgatccccttgctgaaagaaaagttcccagaattcgatttggaaaagaaggactgtttccaagaaccagttgttgactgttctaacagaccatgcattaagaaagaatgcagagaaactacctggatcggttctgttttgtttttctacggtagaaggaccaacgaatccttggaagttttgttggataagtccattccaacgcagaagaactacaacaaaggtacttctgatttcgtcaagaccccaattccagaatctggttggaaaatggttcaaaggttgttcttagaagaggaacgtccacaaatgatcttggaaccattaggtggtaagttggacgaaatctccaaatccgaaatttcattcccacacagaaagggcaacttgtacaacattcaatacttggttaactggggtgacaactccgaaaatgtttcctctcaaaaattggcctggatgcgtaagttgtacaaagatatggaaccatacgttgccaactctccaagaactgcttatttgaactacagagatttggacttcggttccaatgatgaaggttactcttactccaaagctaagatttggggtgaaaagtacttcaacggcaactttaagagattggccaaggttaagtctaaggtcgatccaaacaatttcttcagaaacgaacaatcgatcccaccatatcaatcccat

SEQ ID NO: 57 - protein, 537 aa, Artificial Sequence
  Synthetic Construct
MMGSLQILFVLLFSLVLIKCYSQEDFLECLSKYSKSNVEQNVYTPTSPTYSSILEYAQKNPRWVNSSHPNFIASPRKESDIKPIILCAKKLGLQIKIKSGGHDYEGISYRSKSPFVMLDLSNLNKIEINWKKETVWVQTGATLGQLYYAIANKSNVHGFPGGVCFSIGTGGIISGGGIGTMMRKFGVAADNVVDARVMDVNGKILDKKKMKEDLFWAIRGGGGASFGVILAWKLKLVRVPEKVTVFNVYKKLEGNQNLLQKWENIAHQLTDKLLIRVIIQNDGTGKDKYIEVIFQALFLGLVDELIPLLKEKFPEFDLEKKDCFQEPVVDCSNRPCIKKECRETTWIGSVLFFYGRRTNESLEVLLDKSIPTQKNYNKGTSDFVKTPIPESGWKMVQRLFLEEERPQMILEPLGGKLDEISKSEISFPHRKGNLYNIQYLVNWGDNSENVSSQKLAWMRKLYKDMEPYVANSPRTAYLNYRDLDFGSNDEGYSYSKAKIWGEKYFNGNFKRLAKVKSKVDPNNFFRNEQSIPPYQSH

SEQ ID NO: 58 - DNA, 1551 bp, Artificial Sequence
  CBS86-A0A1U8G0D2-no signal peptide
  CDS (1)..(1551)
atgtctcaagaggatttcttggagtgtttgtccaagtactctaagtccaacgttgaacaaaacgtttacactccaacttctccaacctactcctctattttggaatacgctcaaaagaacccaagatgggttaattcttctcacccaaactttattgcctcgccaagaaaagaatctgacatcaagccaattatcttgtgcgctaagaaattgggcttgcagattaagattaagtccggtggtcatgattacgagggtatttcttacagatctaagtccccattcgttatgttggacttgtctaacttgaacaagatcgagatcaactggaagaaagaaaccgtttgggttcaaactggtgctactttgggtcaactgtattatgctattgccaacaagtctaacgttcatggttttccaggtggtgtttgtttctctattggtactggtggtattatttctggtggtggtataggtactatgatgagaaaatttggtgttgccgctgataacgttgttgatgctagagttatggatgtcaacggtaagatcttggacaagaaaaagatgaaggaagatttgttctgggccattagaggtggtggtggcgcttcttttggtgttattttggcttggaaattgaagttggttagggttccagaaaaggtcactgtttttaacgtctacaaaaagttggaaggcaaccagaacttgttgcaaaagtgggaaaacattgctcatcaattgaccgacaagttgttgatcagagtcatcattcaaaacgacggtactggtaaggataagtacatcgaagttatcttccaagccttgttcttgggtttagttgatgaattgatccccttgctgaaagaaaagttcccagaattcgatttggaaaagaaggactgtttccaagaaccagttgttgactgttctaacagaccatgcattaagaaagaatgcagagaaactacctggatcggttctgttttgtttttctacggtagaaggaccaacgaatccttggaagttttgttggataagtccattccaacgcagaagaactacaacaaaggtacttctgatttcgtcaagaccccaattccagaatctggttggaaaatggttcaaaggttgttcttagaagaggaacgtccacaaatgatcttggaaccattaggtggtaagttggacgaaatctccaaatccgaaatttcattcccacacagaaagggcaacttgtacaacattcaatacttggttaactggggtgacaactccgaaaatgtttcctctcaaaaattggcctggatgcgtaagttgtacaaagatatggaaccatacgttgccaactctccaagaactgcttatttgaactacagagatttggacttcggttccaatgatgaaggttactcttactccaaagctaagatttggggtgaaaagtacttcaacggcaactttaagagattggccaaggttaagtctaaggtcgatccaaacaatttcttcagaaacgaacaatcgatcccaccatatcaatcccat

SEQ ID NO: 59 - protein, 517 aa, Artificial Sequence
  Synthetic Construct
MSQEDFLECLSKYSKSNVEQNVYTPTSPTYSSILEYAQKNPRWVNSSHPNFIASPRKESDIKPIILCAKKLGLQIKIKSGGHDYEGISYRSKSPFVMLDLSNLNKIEINWKKETVWVQTGATLGQLYYAIANKSNVHGFPGGVCFSIGTGGIISGGGIGTMMRKFGVAADNVVDARVMDVNGKILDKKKMKEDLFWAIRGGGGASFGVILAWKLKLVRVPEKVTVFNVYKKLEGNQNLLQKWENIAHQLTDKLLIRVIIQNDGTGKDKYIEVIFQALFLGLVDELIPLLKEKFPEFDLEKKDCFQEPVVDCSNRPCIKKECRETTWIGSVLFFYGRRTNESLEVLLDKSIPTQKNYNKGTSDFVKTPIPESGWKMVQRLFLEEERPQMILEPLGGKLDEISKSEISFPHRKGNLYNIQYLVNWGDNSENVSSQKLAWMRKLYKDMEPYVANSPRTAYLNYRDLDFGSNDEGYSYSKAKIWGEKYFNGNFKRLAKVKSKVDPNNFFRNEQSIPPYQSH

SEQ ID NO: 60 - DNA, 1575 bp, Artificial Sequence
  CBS86-A0A1U8G0D2-no signal peptide-strep Tag
  CDS (1)..(1575)
atgtctcaagaggatttcttggagtgtttgtccaagtactctaagtccaacgttgaacaaaacgtttacactccaacttctccaacctactcctctattttggaatacgctcaaaagaacccaagatgggttaattcttctcacccaaactttattgcctcgccaagaaaagaatctgacatcaagccaattatcttgtgcgctaagaaattgggcttgcagattaagattaagtccggtggtcatgattacgagggtatttcttacagatctaagtccccattcgttatgttggacttgtctaacttgaacaagatcgagatcaactggaagaaagaaaccgtttgggttcaaactggtgctactttgggtcaactgtattatgctattgccaacaagtctaacgttcatggttttccaggtggtgtttgtttctctattggtactggtggtattatttctggtggtggtataggtactatgatgagaaaatttggtgttgccgctgataacgttgttgatgctagagttatggatgtcaacggtaagatcttggacaagaaaaagatgaaggaagatttgttctgggccattagaggtggtggtggcgcttcttttggtgttattttggcttggaaattgaagttggttagggttccagaaaaggtcactgtttttaacgtctacaaaaagttggaaggcaaccagaacttgttgcaaaagtgggaaaacattgctcatcaattgaccgacaagttgttgatcagagtcatcattcaaaacgacggtactggtaaggataagtacatcgaagttatcttccaagccttgttcttgggtttagttgatgaattgatccccttgctgaaagaaaagttcccagaattcgatttggaaaagaaggactgtttccaagaaccagttgttgactgttctaacagaccatgcattaagaaagaatgcagagaaactacctggatcggttctgttttgtttttctacggtagaaggaccaacgaatccttggaagttttgttggataagtccattccaacgcagaagaactacaacaaaggtacttctgatttcgtcaagaccccaattccagaatctggttggaaaatggttcaaaggttgttcttagaagaggaacgtccacaaatgatcttggaaccattaggtggtaagttggacgaaatctccaaatccgaaatttcattcccacacagaaagggcaacttgtacaacattcaatacttggttaactggggtgacaactccgaaaatgtttcctctcaaaaattggcctggatgcgtaagttgtacaaagatatggaaccatacgttgccaactctccaagaactgcttatttgaactacagagatttggacttcggttccaatgatgaaggttactcttactccaaagctaagatttggggtgaaaagtacttcaacggcaactttaagagattggccaaggttaagtctaaggtcgatccaaacaatttcttcagaaacgaacaatcgatcccaccatatcaatcccattggtcacatccacaatttgaaaag

SEQ ID NO: 61 - protein, 525 aa, Artificial Sequence
  Synthetic Construct
MSQEDFLECLSKYSKSNVEQNVYTPTSPTYSSILEYAQKNPRWVNSSHPNFIASPRKESDIKPIILCAKKLGLQIKIKSGGHDYEGISYRSKSPFVMLDLSNLNKIEINWKKETVWVQTGATLGQLYYAIANKSNVHGFPGGVCFSIGTGGIISGGGIGTMMRKFGVAADNVVDARVMDVNGKILDKKKMKEDLFWAIRGGGGASFGVILAWKLKLVRVPEKVTVFNVYKKLEGNQNLLQKWENIAHQLTDKLLIRVIIQNDGTGKDKYIEVIFQALFLGLVDELIPLLKEKFPEFDLEKKDCFQEPVVDCSNRPCIKKECRETTWIGSVLFFYGRRTNESLEVLLDKSIPTQKNYNKGTSDFVKTPIPESGWKMVQRLFLEEERPQMILEPLGGKLDEISKSEISFPHRKGNLYNIQYLVNWGDNSENVSSQKLAWMRKLYKDMEPYVANSPRTAYLNYRDLDFGSNDEGYSYSKAKIWGEKYFNGNFKRLAKVKSKVDPNNFFRNEQSIPPYQSHWSHPQFEK

SEQ ID NO: 62 - DNA, 1632 bp, Artificial Sequence
  CBS86-A0A1U8G0D2-truncated alpha factor -no signal peptide-strep Tag
  CDS (1)..(1632)
atgagatttccttccatcttcacggctgtgctatttgcagcatcctccgcacttgcaatgtctcaagaggatttcttggagtgtttgtccaagtactctaagtccaacgttgaacaaaacgtttacactccaacttctccaacctactcctctattttggaatacgctcaaaagaacccaagatgggttaattcttctcacccaaactttattgcctcgccaagaaaagaatctgacatcaagccaattatcttgtgcgctaagaaattgggcttgcagattaagattaagtccggtggtcatgattacgagggtatttcttacagatctaagtccccattcgttatgttggacttgtctaacttgaacaagatcgagatcaactggaagaaagaaaccgtttgggttcaaactggtgctactttgggtcaactgtattatgctattgccaacaagtctaacgttcatggttttccaggtggtgtttgtttctctattggtactggtggtattatttctggtggtggtataggtactatgatgagaaaatttggtgttgccgctgataacgttgttgatgctagagttatggatgtcaacggtaagatcttggacaagaaaaagatgaaggaagatttgttctgggccattagaggtggtggtggcgcttcttttggtgttattttggcttggaaattgaagttggttagggttccagaaaaggtcactgtttttaacgtctacaaaaagttggaaggcaaccagaacttgttgcaaaagtgggaaaacattgctcatcaattgaccgacaagttgttgatcagagtcatcattcaaaacgacggtactggtaaggataagtacatcgaagttatcttccaagccttgttcttgggtttagttgatgaattgatccccttgctgaaagaaaagttcccagaattcgatttggaaaagaaggactgtttccaagaaccagttgttgactgttctaacagaccatgcattaagaaagaatgcagagaaactacctggatcggttctgttttgtttttctacggtagaaggaccaacgaatccttggaagttttgttggataagtccattccaacgcagaagaactacaacaaaggtacttctgatttcgtcaagaccccaattccagaatctggttggaaaatggttcaaaggttgttcttagaagaggaacgtccacaaatgatcttggaaccattaggtggtaagttggacgaaatctccaaatccgaaatttcattcccacacagaaagggcaacttgtacaacattcaatacttggttaactggggtgacaactccgaaaatgtttcctctcaaaaattggcctggatgcgtaagttgtacaaagatatggaaccatacgttgccaactctccaagaactgcttatttgaactacagagatttggacttcggttccaatgatgaaggttactcttactccaaagctaagatttggggtgaaaagtacttcaacggcaactttaagagattggccaaggttaagtctaaggtcgatccaaacaatttcttcagaaacgaacaatcgatcccaccatatcaatcccattggtcacatccacaatttgaaaag

SEQ ID NO: 63 - protein, 544 aa, Artificial Sequence
  Synthetic Construct
MRFPSIFTAVLFAASSALAMSQEDFLECLSKYSKSNVEQNVYTPTSPTYSSILEYAQKNPRWVNSSHPNFIASPRKESDIKPIILCAKKLGLQIKIKSGGHDYEGISYRSKSPFVMLDLSNLNKIEINWKKETVWVQTGATLGQLYYAIANKSNVHGFPGGVCFSIGTGGIISGGGIGTMMRKFGVAADNVVDARVMDVNGKILDKKKMKEDLFWAIRGGGGASFGVILAWKLKLVRVPEKVTVFNVYKKLEGNQNLLQKWENIAHQLTDKLLIRVIIQNDGTGKDKYIEVIFQALFLGLVDELIPLLKEKFPEFDLEKKDCFQEPVVDCSNRPCIKKECRETTWIGSVLFFYGRRTNESLEVLLDKSIPTQKNYNKGTSDFVKTPIPESGWKMVQRLFLEEERPQMILEPLGGKLDEISKSEISFPHRKGNLYNIQYLVNWGDNSENVSSQKLAWMRKLYKDMEPYVANSPRTAYLNYRDLDFGSNDEGYSYSKAKIWGEKYFNGNFKRLAKVKSKVDPNNFFRNEQSIPPYQSHWSHPQFEK

SEQ ID NO: 64 - DNA, 1842 bp, Artificial Sequence
  CBS86-A0A1U8G0D2-full alpha factor -no signal peptide-strep Tag
  CDS (1)..(1842)
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagctatgtctcaagaggatttcttggagtgtttgtccaagtactctaagtccaacgttgaacaaaacgtttacactccaacttctccaacctactcctctattttggaatacgctcaaaagaacccaagatgggttaattcttctcacccaaactttattgcctcgccaagaaaagaatctgacatcaagccaattatcttgtgcgctaagaaattgggcttgcagattaagattaagtccggtggtcatgattacgagggtatttcttacagatctaagtccccattcgttatgttggacttgtctaacttgaacaagatcgagatcaactggaagaaagaaaccgtttgggttcaaactggtgctactttgggtcaactgtattatgctattgccaacaagtctaacgttcatggttttccaggtggtgtttgtttctctattggtactggtggtattatttctggtggtggtataggtactatgatgagaaaatttggtgttgccgctgataacgttgttgatgctagagttatggatgtcaacggtaagatcttggacaagaaaaagatgaaggaagatttgttctgggccattagaggtggtggtggcgcttcttttggtgttattttggcttggaaattgaagttggttagggttccagaaaaggtcactgtttttaacgtctacaaaaagttggaaggcaaccagaacttgttgcaaaagtgggaaaacattgctcatcaattgaccgacaagttgttgatcagagtcatcattcaaaacgacggtactggtaaggataagtacatcgaagttatcttccaagccttgttcttgggtttagttgatgaattgatccccttgctgaaagaaaagttcccagaattcgatttggaaaagaaggactgtttccaagaaccagttgttgactgttctaacagaccatgcattaagaaagaatgcagagaaactacctggatcggttctgttttgtttttctacggtagaaggaccaacgaatccttggaagttttgttggataagtccattccaacgcagaagaactacaacaaaggtacttctgatttcgtcaagaccccaattccagaatctggttggaaaatggttcaaaggttgttcttagaagaggaacgtccacaaatgatcttggaaccattaggtggtaagttggacgaaatctccaaatccgaaatttcattcccacacagaaagggcaacttgtacaacattcaatacttggttaactggggtgacaactccgaaaatgtttcctctcaaaaattggcctggatgcgtaagttgtacaaagatatggaaccatacgttgccaactctccaagaactgcttatttgaactacagagatttggacttcggttccaatgatgaaggttactcttactccaaagctaagatttggggtgaaaagtacttcaacggcaactttaagagattggccaaggttaagtctaaggtcgatccaaacaatttcttcagaaacgaacaatcgatcccaccatatcaatcccattggtcacatccacaatttgaaaag

SEQ ID NO: 65 - protein, 614 aa, Artificial Sequence
  Synthetic Construct
MRFPSIFTAVLFAASSALAAPVNTTTEDETAQIPAEAVIGYSDLEGDFDVAVLPFSNSTNNGLLFINTTIASIAAKEEGVSLEKREAEAMSQEDFLECLSKYSKSNVEQNVYTPTSPTYSSILEYAQKNPRWVNSSHPNFIASPRKESDIKPIILCAKKLGLQIKIKSGGHDYEGISYRSKSPFVMLDLSNLNKIEINWKKETVWVQTGATLGQLYYAIANKSNVHGFPGGVCFSIGTGGIISGGGIGTMMRKFGVAADNVVDARVMDVNGKILDKKKMKEDLFWAIRGGGGASFGVILAWKLKLVRVPEKVTVFNVYKKLEGNQNLLQKWENIAHQLTDKLLIRVIIQNDGTGKDKYIEVIFQALFLGLVDELIPLLKEKFPEFDLEKKDCFQEPVVDCSNRPCIKKECRETTWIGSVLFFYGRRTNESLEVLLDKSIPTQKNYNKGTSDFVKTPIPESGWKMVQRLFLEEERPQMILEPLGGKLDEISKSEISFPHRKGNLYNIQYLVNWGDNSENVSSQKLAWMRKLYKDMEPYVANSPRTAYLNYRDLDFGSNDEGYSYSKAKIWGEKYFNGNFKRLAKVKSKVDPNNFFRNEQSIPPYQSHWSHPQFEK

SEQ ID NO: 66 - DNA, 1629 bp, Artificial Sequence
  CBS94-A0A1S3XA06
  CDS (1)..(1629)
atgggtagattgcagttgttctcttgcttgttggtttccttcttgttgttgattgaagctaacgcccaacaagagttcttgcaatgtatctactctcactcctccgagaatattaagaagcacattcatttcccaaacagcccaacttactcttcgttgttggaatacgctcaaaagaatccaagatggctgaattcttctttcgcccatccaattttcattatcgctccaaagaacgaatccgaaatccagccaattatcttgtgctctcaaaagttcggcttgcaaatcagagttaagtctggtggtcatgattacgaaggtttgtctttcagatctgtcactaacacccaattcgttatcttggacttgatcaacttggacgatatcagaatcgacaagaacgaagaaactgcttggattcaaactggtgttactatgggtcagttgtactacgaaattgccaagaagtctaagatcttggcttttccaggtggtctatatccatctgttggttctggtggtttgatttcaggtggtggtattggtactttgatgagaaagtttggtttgtccgctgataacgtcattgatgctagagttatggatgtcaacggtagaatcttggacaaaaagtctatgggcgaagatatgttctgggctattagaggtggtggcggttcttcttttggtgttattttggcttggaagatcaagttggttagaatcccaccaaaggttactgttttcaccgttagaagaaagttggaaggtaacaccatcaacttgttgcaaagatggcaaaacgtttcccataagttcccaaaggatttgttcatgagagtcttgatccaaaacatgggtttcggtaacgaaaagatcgttcaagtttcattccagggtttgtttttgggtagagcttctgaattgacccctttgttgaatcaaactttcccagaattcggtttggacccaaaaaactgtttccaagatccagttgttaactgcaacgaattgcccttcattaagaaagaatgcttcgaagttccatggatcagatctaccttgtactttgcttctaagaggaccaacaactccattgaattcttggttaacaacaccgtttctcagaccaagaactaccaaaaagctacttccgatttcgttaagaccccaatgcaagaagaggtttggggtatgatcaaagacttgttcttggaagaagagaagcccatgattattttggaccctttaggtggtaagttggacgaaatttctgaatccgaattgccatttccacacagaaagggtaacttgttcaacatccagtacatggttaattggggtgacaactccgaatctatctcctccaaaaaaatcaaatggctgcgtgagttgtacgagaagatgaagccatttttgtctcattgtcctagaaccgcttacttgaactacagagatttggacttcggtactaatgatggtgtctacagatactctaaagccaaagtttggggtgctaagtacttcaacgaaaactttgaaagattggccaaggtcaagtctaaagttgatccaggtaatttcttcaggtacgaacaatctattccaccattctctgtttccacc

SEQ ID NO: 67 - protein, 543 aa, Artificial Sequence
  Synthetic Construct
MGRLQLFSCLLVSFLLLIEANAQQEFLQCIYSHSSENIKKHIHFPNSPTYSSLLEYAQKNPRWLNSSFAHPIFIIAPKNESEIQPIILCSQKFGLQIRVKSGGHDYEGLSFRSVTNTQFVILDLINLDDIRIDKNEETAWIQTGVTMGQLYYEIAKKSKILAFPGGLYPSVGSGGLISGGGIGTLMRKFGLSADNVIDARVMDVNGRILDKKSMGEDMFWAIRGGGGSSFGVILAWKIKLVRIPPKVTVFTVRRKLEGNTINLLQRWQNVSHKFPKDLFMRVLIQNMGFGNEKIVQVSFQGLFLGRASELTPLLNQTFPEFGLDPKNCFQDPVVNCNELPFIKKECFEVPWIRSTLYFASKRTNNSIEFLVNNTVSQTKNYQKATSDFVKTPMQEEVWGMIKDLFLEEEKPMIILDPLGGKLDEISESELPFPHRKGNLFNIQYMVNWGDNSESISSKKIKWLRELYEKMKPFLSHCPRTAYLNYRDLDFGTNDGVYRYSKAKVWGAKYFNENFERLAKVKSKVDPGNFFRYEQSIPPFSVST

SEQ ID NO: 68 - DNA, 1569 bp, Artificial Sequence
  CBS94-A0A1S3XA06-no signal peptide
  CDS (1)..(1569)
atggcccaacaagagttcttgcaatgtatctactctcactcctccgagaatattaagaagcacattcatttcccaaacagcccaacttactcttcgttgttggaatacgctcaaaagaatccaagatggctgaattcttctttcgcccatccaattttcattatcgctccaaagaacgaatccgaaatccagccaattatcttgtgctctcaaaagttcggcttgcaaatcagagttaagtctggtggtcatgattacgaaggtttgtctttcagatctgtcactaacacccaattcgttatcttggacttgatcaacttggacgatatcagaatcgacaagaacgaagaaactgcttggattcaaactggtgttactatgggtcagttgtactacgaaattgccaagaagtctaagatcttggcttttccaggtggtctatatccatctgttggttctggtggtttgatttcaggtggtggtattggtactttgatgagaaagtttggtttgtccgctgataacgtcattgatgctagagttatggatgtcaacggtagaatcttggacaaaaagtctatgggcgaagatatgttctgggctattagaggtggtggcggttcttcttttggtgttattttggcttggaagatcaagttggttagaatcccaccaaaggttactgttttcaccgttagaagaaagttggaaggtaacaccatcaacttgttgcaaagatggcaaaacgtttcccataagttcccaaaggatttgttcatgagagtcttgatccaaaacatgggtttcggtaacgaaaagatcgttcaagtttcattccagggtttgtttttgggtagagcttctgaattgacccctttgttgaatcaaactttcccagaattcggtttggacccaaaaaactgtttccaagatccagttgttaactgcaacgaattgcccttcattaagaaagaatgcttcgaagttccatggatcagatctaccttgtactttgcttctaagaggaccaacaactccattgaattcttggttaacaacaccgtttctcagaccaagaactaccaaaaagctacttccgatttcgttaagaccccaatgcaagaagaggtttggggtatgatcaaagacttgttcttggaagaagagaagcccatgattattttggaccctttaggtggtaagttggacgaaatttctgaatccgaattgccatttccacacagaaagggtaacttgttcaacatccagtacatggttaattggggtgacaactccgaatctatctcctccaaaaaaatcaaatggctgcgtgagttgtacgagaagatgaagccatttttgtctcattgtcctagaaccgcttacttgaactacagagatttggacttcggtactaatgatggtgtctacagatactctaaagccaaagtttggggtgctaagtacttcaacgaaaactttgaaagattggccaaggtcaagtctaaagttgatccaggtaatttcttcaggtacgaacaatctattccaccattctctgtttccacc

SEQ ID NO: 69 - protein, 523 aa, Artificial Sequence
  Synthetic Construct
MAQQEFLQCIYSHSSENIKKHIHFPNSPTYSSLLEYAQKNPRWLNSSFAHPIFIIAPKNESEIQPIILCSQKFGLQIRVKSGGHDYEGLSFRSVTNTQFVILDLINLDDIRIDKNEETAWIQTGVTMGQLYYEIAKKSKILAFPGGLYPSVGSGGLISGGGIGTLMRKFGLSADNVIDARVMDVNGRILDKKSMGEDMFWAIRGGGGSSFGVILAWKIKLVRIPPKVTVFTVRRKLEGNTINLLQRWQNVSHKFPKDLFMRVLIQNMGFGNEKIVQVSFQGLFLGRASELTPLLNQTFPEFGLDPKNCFQDPVVNCNELPFIKKECFEVPWIRSTLYFASKRTNNSIEFLVNNTVSQTKNYQKATSDFVKTPMQEEVWGMIKDLFLEEEKPMIILDPLGGKLDEISESELPFPHRKGNLFNIQYMVNWGDNSESISSKKIKWLRELYEKMKPFLSHCPRTAYLNYRDLDFGTNDGVYRYSKAKVWGAKYFNENFERLAKVKSKVDPGNFFRYEQSIPPFSVST

SEQ ID NO: 70 - DNA, 1593 bp, Artificial Sequence
  CBS94-A0A1S3XA06-no signal peptide-strep Tag
  CDS (1)..(1593)
atggcccaacaagagttcttgcaatgtatctactctcactcctccgagaatattaagaagcacattcatttcccaaacagcccaacttactcttcgttgttggaatacgctcaaaagaatccaagatggctgaattcttctttcgcccatccaattttcattatcgctccaaagaacgaatccgaaatccagccaattatcttgtgctctcaaaagttcggcttgcaaatcagagttaagtctggtggtcatgattacgaaggtttgtctttcagatctgtcactaacacccaattcgttatcttggacttgatcaacttggacgatatcagaatcgacaagaacgaagaaactgcttggattcaaactggtgttactatgggtcagttgtactacgaaattgccaagaagtctaagatcttggcttttccaggtggtctatatccatctgttggttctggtggtttgatttcaggtggtggtattggtactttgatgagaaagtttggtttgtccgctgataacgtcattgatgctagagttatggatgtcaacggtagaatcttggacaaaaagtctatgggcgaagatatgttctgggctattagaggtggtggcggttcttcttttggtgttattttggcttggaagatcaagttggttagaatcccaccaaaggttactgttttcaccgttagaagaaagttggaaggtaacaccatcaacttgttgcaaagatggcaaaacgtttcccataagttcccaaaggatttgttcatgagagtcttgatccaaaacatgggtttcggtaacgaaaagatcgttcaagtttcattccagggtttgtttttgggtagagcttctgaattgacccctttgttgaatcaaactttcccagaattcggtttggacccaaaaaactgtttccaagatccagttgttaactgcaacgaattgcccttcattaagaaagaatgcttcgaagttccatggatcagatctaccttgtactttgcttctaagaggaccaacaactccattgaattcttggttaacaacaccgtttctcagaccaagaactaccaaaaagctacttccgatttcgttaagaccccaatgcaagaagaggtttggggtatgatcaaagacttgttcttggaagaagagaagcccatgattattttggaccctttaggtggtaagttggacgaaatttctgaatccgaattgccatttccacacagaaagggtaacttgttcaacatccagtacatggttaattggggtgacaactccgaatctatctcctccaaaaaaatcaaatggctgcgtgagttgtacgagaagatgaagccatttttgtctcattgtcctagaaccgcttacttgaactacagagatttggacttcggtactaatgatggtgtctacagatactctaaagccaaagtttggggtgctaagtacttcaacgaaaactttgaaagattggccaaggtcaagtctaaagttgatccaggtaatttcttcaggtacgaacaatctattccaccattctctgtttccacctggtcacatccacaatttgaaaag

SEQ ID NO: 71 - protein, 531 aa, Artificial Sequence
  Synthetic Construct
MAQQEFLQCIYSHSSENIKKHIHFPNSPTYSSLLEYAQKNPRWLNSSFAHPIFIIAPKNESEIQPIILCSQKFGLQIRVKSGGHDYEGLSFRSVTNTQFVILDLINLDDIRIDKNEETAWIQTGVTMGQLYYEIAKKSKILAFPGGLYPSVGSGGLISGGGIGTLMRKFGLSADNVIDARVMDVNGRILDKKSMGEDMFWAIRGGGGSSFGVILAWKIKLVRIPPKVTVFTVRRKLEGNTINLLQRWQNVSHKFPKDLFMRVLIQNMGFGNEKIVQVSFQGLFLGRASELTPLLNQTFPEFGLDPKNCFQDPVVNCNELPFIKKECFEVPWIRSTLYFASKRTNNSIEFLVNNTVSQTKNYQKATSDFVKTPMQEEVWGMIKDLFLEEEKPMIILDPLGGKLDEISESELPFPHRKGNLFNIQYMVNWGDNSESISSKKIKWLRELYEKMKPFLSHCPRTAYLNYRDLDFGTNDGVYRYSKAKVWGAKYFNENFERLAKVKSKVDPGNFFRYEQSIPPFSVSTWSHPQFEK

SEQ ID NO: 72 - DNA, 1650 bp, Artificial Sequence
  CBS94-A0A1S3XA06-truncated alpha factor-no signal peptide-strep Tag
  CDS (1)..(1650)
atgagatttccttccatcttcacggctgtgctatttgcagcatcctccgcacttgcaatggcccaacaagagttcttgcaatgtatctactctcactcctccgagaatattaagaagcacattcatttcccaaacagcccaacttactcttcgttgttggaatacgctcaaaagaatccaagatggctgaattcttctttcgcccatccaattttcattatcgctccaaagaacgaatccgaaatccagccaattatcttgtgctctcaaaagttcggcttgcaaatcagagttaagtctggtggtcatgattacgaaggtttgtctttcagatctgtcactaacacccaattcgttatcttggacttgatcaacttggacgatatcagaatcgacaagaacgaagaaactgcttggattcaaactggtgttactatgggtcagttgtactacgaaattgccaagaagtctaagatcttggcttttccaggtggtctatatccatctgttggttctggtggtttgatttcaggtggtggtattggtactttgatgagaaagtttggtttgtccgctgataacgtcattgatgctagagttatggatgtcaacggtagaatcttggacaaaaagtctatgggcgaagatatgttctgggctattagaggtggtggcggttcttcttttggtgttattttggcttggaagatcaagttggttagaatcccaccaaaggttactgttttcaccgttagaagaaagttggaaggtaacaccatcaacttgttgcaaagatggcaaaacgtttcccataagttcccaaaggatttgttcatgagagtcttgatccaaaacatgggtttcggtaacgaaaagatcgttcaagtttcattccagggtttgtttttgggtagagcttctgaattgacccctttgttgaatcaaactttcccagaattcggtttggacccaaaaaactgtttccaagatccagttgttaactgcaacgaattgcccttcattaagaaagaatgcttcgaagttccatggatcagatctaccttgtactttgcttctaagaggaccaacaactccattgaattcttggttaacaacaccgtttctcagaccaagaactaccaaaaagctacttccgatttcgttaagaccccaatgcaagaagaggtttggggtatgatcaaagacttgttcttggaagaagagaagcccatgattattttggaccctttaggtggtaagttggacgaaatttctgaatccgaattgccatttccacacagaaagggtaacttgttcaacatccagtacatggttaattggggtgacaactccgaatctatctcctccaaaaaaatcaaatggctgcgtgagttgtacgagaagatgaagccatttttgtctcattgtcctagaaccgcttacttgaactacagagatttggacttcggtactaatgatggtgtctacagatactctaaagccaaagtttggggtgctaagtacttcaacgaaaactttgaaagattggccaaggtcaagtctaaagttgatccaggtaatttcttcaggtacgaacaatctattccaccattctctgtttccacctggtcacatccacaatttgaaaag

SEQ ID NO: 73 - protein, 550 aa, Artificial Sequence
  Synthetic Construct
MRFPSIFTAVLFAASSALAMAQQEFLQCIYSHSSENIKKHIHFPNSPTYSSLLEYAQKNPRWLNSSFAHPIFIIAPKNESEIQPIILCSQKFGLQIRVKSGGHDYEGLSFRSVTNTQFVILDLINLDDIRIDKNEETAWIQTGVTMGQLYYEIAKKSKILAFPGGLYPSVGSGGLISGGGIGTLMRKFGLSADNVIDARVMDVNGRILDKKSMGEDMFWAIRGGGGSSFGVILAWKIKLVRIPPKVTVFTVRRKLEGNTINLLQRWQNVSHKFPKDLFMRVLIQNMGFGNEKIVQVSFQGLFLGRASELTPLLNQTFPEFGLDPKNCFQDPVVNCNELPFIKKECFEVPWIRSTLYFASKRTNNSIEFLVNNTVSQTKNYQKATSDFVKTPMQEEVWGMIKDLFLEEEKPMIILDPLGGKLDEISESELPFPHRKGNLFNIQYMVNWGDNSESISSKKIKWLRELYEKMKPFLSHCPRTAYLNYRDLDFGTNDGVYRYSKAKVWGAKYFNENFERLAKVKSKVDPGNFFRYEQSIPPFSVSTWSHPQFEK

SEQ ID NO: 74 - DNA, 1860 bp, Artificial Sequence
  CBS94-A0A1S3XA06-full alpha factor-no signal peptide-strep Tag
  CDS (1)..(1860)
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagctatggcccaacaagagttcttgcaatgtatctactctcactcctccgagaatattaagaagcacattcatttcccaaacagcccaacttactcttcgttgttggaatacgctcaaaagaatccaagatggctgaattcttctttcgcccatccaattttcattatcgctccaaagaacgaatccgaaatccagccaattatcttgtgctctcaaaagttcggcttgcaaatcagagttaagtctggtggtcatgattacgaaggtttgtctttcagatctgtcactaacacccaattcgttatcttggacttgatcaacttggacgatatcagaatcgacaagaacgaagaaactgcttggattcaaactggtgttactatgggtcagttgtactacgaaattgccaagaagtctaagatcttggcttttccaggtggtctatatccatctgttggttctggtggtttgatttcaggtggtggtattggtactttgatgagaaagtttggtttgtccgctgataacgtcattgatgctagagttatggatgtcaacggtagaatcttggacaaaaagtctatgggcgaagatatgttctgggctattagaggtggtggcggttcttcttttggtgttattttggcttggaagatcaagttggttagaatcccaccaaaggttactgttttcaccgttagaagaaagttggaaggtaacaccatcaacttgttgcaaagatggcaaaacgtttcccataagttcccaaaggatttgttcatgagagtcttgatccaaaacatgggtttcggtaacgaaaagatcgttcaagtttcattccagggtttgtttttgggtagagcttctgaattgacccctttgttgaatcaaactttcccagaattcggtttggacccaaaaaactgtttccaagatccagttgttaactgcaacgaattgcccttcattaagaaagaatgcttcgaagttccatggatcagatctaccttgtactttgcttctaagaggaccaacaactccattgaattcttggttaacaacaccgtttctcagaccaagaactaccaaaaagctacttccgatttcgttaagaccccaatgcaagaagaggtttggggtatgatcaaagacttgttcttggaagaagagaagcccatgattattttggaccctttaggtggtaagttggacgaaatttctgaatccgaattgccatttccacacagaaagggtaacttgttcaacatccagtacatggttaattggggtgacaactccgaatctatctcctccaaaaaaatcaaatggctgcgtgagttgtacgagaagatgaagccatttttgtctcattgtcctagaaccgcttacttgaactacagagatttggacttcggtactaatgatggtgtctacagatactctaaagccaaagtttggggtgctaagtacttcaacgaaaactttgaaagattggccaaggtcaagtctaaagttgatccaggtaatttcttcaggtacgaacaatctattccaccattctctgtttccacctggtcacatccacaatttgaaaag

SEQ ID NO: 75 - protein, 620 aa, Artificial Sequence
  Synthetic Construct
MRFPSIFTAVLFAASSALAAPVNTTTEDETAQIPAEAVIGYSDLEGDFDVAVLPFSNSTNNGLLFINTTIASIAAKEEGVSLEKREAEAMAQQEFLQCIYSHSSENIKKHIHFPNSPTYSSLLEYAQKNPRWLNSSFAHPIFIIAPKNESEIQPIILCSQKFGLQIRVKSGGHDYEGLSFRSVTNTQFVILDLINLDDIRIDKNEETAWIQTGVTMGQLYYEIAKKSKILAFPGGLYPSVGSGGLISGGGIGTLMRKFGLSADNVIDARVMDVNGRILDKKSMGEDMFWAIRGGGGSSFGVILAWKIKLVRIPPKVTVFTVRRKLEGNTINLLQRWQNVSHKFPKDLFMRVLIQNMGFGNEKIVQVSFQGLFLGRASELTPLLNQTFPEFGLDPKNCFQDPVVNCNELPFIKKECFEVPWIRSTLYFASKRTNNSIEFLVNNTVSQTKNYQKATSDFVKTPMQEEVWGMIKDLFLEEEKPMIILDPLGGKLDEISESELPFPHRKGNLFNIQYMVNWGDNSESISSKKIKWLRELYEKMKPFLSHCPRTAYLNYRDLDFGTNDGVYRYSKAKVWGAKYFNENFERLAKVKSKVDPGNFFRYEQSIPPFSVSTWSHPQFEK

SEQ ID NO: 76 - DNA, 1608 bp, Artificial Sequence
  CBS99-A0A1S3BDA8
  CDS (1)..(1608)
atgaagttctcctctaccttgattccactgtctttggtttttatcgttgtctcctctgcttctttgtgtgcttctgcttctccacaaaagtaccaaaatttcttgcagtgcttgtccgaacactcttctaaatcttacccaatctccaaggttgtctataccccaatcaattcctcttactcctctgttttggacttctccattaggaacttgttgttctctaaaccagaaacgccaaagcctttgttgattattactccatctcacgtgtcccatattcaagctgctgttatttgttctaagtcccatggcttgcaaatcagaactagatctggtggtcatgatttcgaaggtttgtcttatgttgcttacagaccattcatcgttgtcgacttgattaacttgagatccgttaaggttgaagtcgaaaacaatactgcttgggttgaatctggtgctactttgggtgagttgtattacagaattggtgaaaagtctaggaccttggcttttccagctggtgtttgtccaactgttggtataggtggtcatttttctggtggtggttatggtttgatgttgagaaaatttggtttggccgctgataacgtcattgatgcttatttggttgatgccaacggtaaggttttggacaaagaatctatgggcgaagatttgttctgggctattagaggtggtggtggcggttcttttggtatagttgttgcttggaagatcaagttggttccagttccagaaactgttactatttgctctaccgacagaaacttggaagaagatgccattaagttgatccacagatggcaatacgttggtaacaaattggacgagaatatctacttgggtatcattttgactggtggtaacgcttctactcaagctggtattactaatccaactgccagattcttcagcttgtttttgggtagagctgatgaattggttactaccttgtctactatcttcccagaattgggtttgatcaagcaagattgtgttgaagcttcttgggtcgaatccactttgattattccaattggtgttcagccaatcgaaaccttggaaccattattgaacagaactttgaccaccttggactccactaagattaagtctgattacatcaccgaacctattccagttgctgctattaaggatatctggcagagattgaaaacccaagacattgaaacctctcagttggtttttgttccatacggtggtagaatgtcccaaatctctgaatctgaaactccattctctcatagagccagatacttgttcaagatcggttatgttgtaggttggaaggaccaatctttgaaggctaagaagagacatatctcctggttgagagaagtttatgagtacatggctccattcgtttctaaatcaccaagagctgcttacaccaattacagagacttggatattggctccaacaacaaatacggtaagacctcttacaagagagcttctgtttggggtttgaagtatttcggtaacaacttcgatagactggtttacgttaagaccaaggttgatccatacgatttcttcagacacgaacaatctattcccaccttg

SEQ ID NO: 77 - protein, 536 aa, Artificial Sequence
  Synthetic Construct
MKFSSTLIPLSLVFIVVSSASLCASASPQKYQNFLQCLSEHSSKSYPISKVVYTPINSSYSSVLDFSIRNLLFSKPETPKPLLIITPSHVSHIQAAVICSKSHGLQIRTRSGGHDFEGLSYVAYRPFIVVDLINLRSVKVEVENNTAWVESGATLGELYYRIGEKSRTLAFPAGVCPTVGIGGHFSGGGYGLMLRKFGLAADNVIDAYLVDANGKVLDKESMGEDLFWAIRGGGGGSFGIVVAWKIKLVPVPETVTICSTDRNLEEDAIKLIHRWQYVGNKLDENIYLGIILTGGNASTQAGITNPTARFFSLFLGRADELVTTLSTIFPELGLIKQDCVEASWVESTLIIPIGVQPIETLEPLLNRTLTTLDSTKIKSDYITEPIPVAAIKDIWQRLKTQDIETSQLVFVPYGGRMSQISESETPFSHRARYLFKIGYVVGWKDQSLKAKKRHISWLREVYEYMAPFVSKSPRAAYTNYRDLDIGSNNKYGKTSYKRASVWGLKYFGNNFDRLVYVKTKVDPYDFFRHEQSIPTL

SEQ ID NO: 78 - DNA, 1536 bp, Artificial Sequence
  CBS99-A0A1S3BDA8-no signal peptide
  CDS (1)..(1536)
atggcttctccacaaaagtaccaaaatttcttgcagtgcttgtccgaacactcttctaaatcttacccaatctccaaggttgtctataccccaatcaattcctcttactcctctgttttggacttctccattaggaacttgttgttctctaaaccagaaacgccaaagcctttgttgattattactccatctcacgtgtcccatattcaagctgctgttatttgttctaagtcccatggcttgcaaatcagaactagatctggtggtcatgatttcgaaggtttgtcttatgttgcttacagaccattcatcgttgtcgacttgattaacttgagatccgttaaggttgaagtcgaaaacaatactgcttgggttgaatctggtgctactttgggtgagttgtattacagaattggtgaaaagtctaggaccttggcttttccagctggtgtttgtccaactgttggtataggtggtcatttttctggtggtggttatggtttgatgttgagaaaatttggtttggccgctgataacgtcattgatgcttatttggttgatgccaacggtaaggttttggacaaagaatctatgggcgaagatttgttctgggctattagaggtggtggtggcggttcttttggtatagttgttgcttggaagatcaagttggttccagttccagaaactgttactatttgctctaccgacagaaacttggaagaagatgccattaagttgatccacagatggcaatacgttggtaacaaattggacgagaatatctacttgggtatcattttgactggtggtaacgcttctactcaagctggtattactaatccaactgccagattcttcagcttgtttttgggtagagctgatgaattggttactaccttgtctactatcttcccagaattgggtttgatcaagcaagattgtgttgaagcttcttgggtcgaatccactttgattattccaattggtgttcagccaatcgaaaccttggaaccattattgaacagaactttgaccaccttggactccactaagattaagtctgattacatcaccgaacctattccagttgctgctattaaggatatctggcagagattgaaaacccaagacattgaaacctctcagttggtttttgttccatacggtggtagaatgtcccaaatctctgaatctgaaactccattctctcatagagccagatacttgttcaagatcggttatgttgtaggttggaaggaccaatctttgaaggctaagaagagacatatctcctggttgagagaagtttatgagtacatggctccattcgtttctaaatcaccaagagctgcttacaccaattacagagacttggatattggctccaacaacaaatacggtaagacctcttacaagagagcttctgtttggggtttgaagtatttcggtaacaacttcgatagactggtttacgttaagaccaaggttgatccatacgatttcttcagacacgaacaatctattcccaccttg

SEQ ID NO: 79 - protein, 512 aa, Artificial Sequence
  Synthetic Construct
MASPQKYQNFLQCLSEHSSKSYPISKVVYTPINSSYSSVLDFSIRNLLFSKPETPKPLLIITPSHVSHIQAAVICSKSHGLQIRTRSGGHDFEGLSYVAYRPFIVVDLINLRSVKVEVENNTAWVESGATLGELYYRIGEKSRTLAFPAGVCPTVGIGGHFSGGGYGLMLRKFGLAADNVIDAYLVDANGKVLDKESMGEDLFWAIRGGGGGSFGIVVAWKIKLVPVPETVTICSTDRNLEEDAIKLIHRWQYVGNKLDENIYLGIILTGGNASTQAGITNPTARFFSLFLGRADELVTTLSTIFPELGLIKQDCVEASWVESTLIIPIGVQPIETLEPLLNRTLTTLDSTKIKSDYITEPIPVAAIKDIWQRLKTQDIETSQLVFVPYGGRMSQISESETPFSHRARYLFKIGYVVGWKDQSLKAKKRHISWLREVYEYMAPFVSKSPRAAYTNYRDLDIGSNNKYGKTSYKRASVWGLKYFGNNFDRLVYVKTKVDPYDFFRHEQSIPTL

SEQ ID NO: 80 - DNA, 1560 bp, Artificial Sequence
  CBS99-A0A1S3BDA8-no signal peptide-strep Tag
  CDS (1)..(1560)
atggcttctccacaaaagtaccaaaatttcttgcagtgcttgtccgaacactcttctaaatcttacccaatctccaaggttgtctataccccaatcaattcctcttactcctctgttttggacttctccattaggaacttgttgttctctaaaccagaaacgccaaagcctttgttgattattactccatctcacgtgtcccatattcaagctgctgttatttgttctaagtcccatggcttgcaaatcagaactagatctggtggtcatgatttcgaaggtttgtcttatgttgcttacagaccattcatcgttgtcgacttgattaacttgagatccgttaaggttgaagtcgaaaacaatactgcttgggttgaatctggtgctactttgggtgagttgtattacagaattggtgaaaagtctaggaccttggcttttccagctggtgtttgtccaactgttggtataggtggtcatttttctggtggtggttatggtttgatgttgagaaaatttggtttggccgctgataacgtcattgatgcttatttggttgatgccaacggtaaggttttggacaaagaatctatgggcgaagatttgttctgggctattagaggtggtggtggcggttcttttggtatagttgttgcttggaagatcaagttggttccagttccagaaactgttactatttgctctaccgacagaaacttggaagaagatgccattaagttgatccacagatggcaatacgttggtaacaaattggacgagaatatctacttgggtatcattttgactggtggtaacgcttctactcaagctggtattactaatccaactgccagattcttcagcttgtttttgggtagagctgatgaattggttactaccttgtctactatcttcccagaattgggtttgatcaagcaagattgtgttgaagcttcttgggtcgaatccactttgattattccaattggtgttcagccaatcgaaaccttggaaccattattgaacagaactttgaccaccttggactccactaagattaagtctgattacatcaccgaacctattccagttgctgctattaaggatatctggcagagattgaaaacccaagacattgaaacctctcagttggtttttgttccatacggtggtagaatgtcccaaatctctgaatctgaaactccattctctcatagagccagatacttgttcaagatcggttatgttgtaggttggaaggaccaatctttgaaggctaagaagagacatatctcctggttgagagaagtttatgagtacatggctccattcgtttctaaatcaccaagagctgcttacaccaattacagagacttggatattggctccaacaacaaatacggtaagacctcttacaagagagcttctgtttggggtttgaagtatttcggtaacaacttcgatagactggtttacgttaagaccaaggttgatccatacgatttcttcagacacgaacaatctattcccaccttgtggtcacatccacaatttgaaaag

SEQ ID NO: 81 - protein, 520 aa, Artificial Sequence
  Synthetic Construct
MASPQKYQNFLQCLSEHSSKSYPISKVVYTPINSSYSSVLDFSIRNLLFSKPETPKPLLIITPSHVSHIQAAVICSKSHGLQIRTRSGGHDFEGLSYVAYRPFIVVDLINLRSVKVEVENNTAWVESGATLGELYYRIGEKSRTLAFPAGVCPTVGIGGHFSGGGYGLMLRKFGLAADNVIDAYLVDANGKVLDKESMGEDLFWAIRGGGGGSFGIVVAWKIKLVPVPETVTICSTDRNLEEDAIKLIHRWQYVGNKLDENIYLGIILTGGNASTQAGITNPTARFFSLFLGRADELVTTLSTIFPELGLIKQDCVEASWVESTLIIPIGVQPIETLEPLLNRTLTTLDSTKIKSDYITEPIPVAAIKDIWQRLKTQDIETSQLVFVPYGGRMSQISESETPFSHRARYLFKIGYVVGWKDQSLKAKKRHISWLREVYEYMAPFVSKSPRAAYTNYRDLDIGSNNKYGKTSYKRASVWGLKYFGNNFDRLVYVKTKVDPYDFFRHEQSIPTLWSHPQFEK

SEQ ID NO: 82 - DNA, 1617 bp, Artificial Sequence
  CBS99-A0A1S3BDA8- truncated alpha factor-no signal peptide-strep Tag
  CDS (1)..(1617)
atgagatttccttccatcttcacggctgtgctatttgcagcatcctccgcacttgcaatggcttctccacaaaagtaccaaaatttcttgcagtgcttgtccgaacactcttctaaatcttacccaatctccaaggttgtctataccccaatcaattcctcttactcctctgttttggacttctccattaggaacttgttgttctctaaaccagaaacgccaaagcctttgttgattattactccatctcacgtgtcccatattcaagctgctgttatttgttctaagtcccatggcttgcaaatcagaactagatctggtggtcatgatttcgaaggtttgtcttatgttgcttacagaccattcatcgttgtcgacttgattaacttgagatccgttaaggttgaagtcgaaaacaatactgcttgggttgaatctggtgctactttgggtgagttgtattacagaattggtgaaaagtctaggaccttggcttttccagctggtgtttgtccaactgttggtataggtggtcatttttctggtggtggttatggtttgatgttgagaaaatttggtttggccgctgataacgtcattgatgcttatttggttgatgccaacggtaaggttttggacaaagaatctatgggcgaagatttgttctgggctattagaggtggtggtggcggttcttttggtatagttgttgcttggaagatcaagttggttccagttccagaaactgttactatttgctctaccgacagaaacttggaagaagatgccattaagttgatccacagatggcaatacgttggtaacaaattggacgagaatatctacttgggtatcattttgactggtggtaacgcttctactcaagctggtattactaatccaactgccagattcttcagcttgtttttgggtagagctgatgaattggttactaccttgtctactatcttcccagaattgggtttgatcaagcaagattgtgttgaagcttcttgggtcgaatccactttgattattccaattggtgttcagccaatcgaaaccttggaaccattattgaacagaactttgaccaccttggactccactaagattaagtctgattacatcaccgaacctattccagttgctgctattaaggatatctggcagagattgaaaacccaagacattgaaacctctcagttggtttttgttccatacggtggtagaatgtcccaaatctctgaatctgaaactccattctctcatagagccagatacttgttcaagatcggttatgttgtaggttggaaggaccaatctttgaaggctaagaagagacatatctcctggttgagagaagtttatgagtacatggctccattcgtttctaaatcaccaagagctgcttacaccaattacagagacttggatattggctccaacaacaaatacggtaagacctcttacaagagagcttctgtttggggtttgaagtatttcggtaacaacttcgatagactggtttacgttaagaccaaggttgatccatacgatttcttcagacacgaacaatctattcccaccttgtggtcacatccacaatttgaaaag

SEQ ID NO: 83 - protein, 539 aa, Artificial Sequence
  Synthetic Construct
MRFPSIFTAVLFAASSALAMASPQKYQNFLQCLSEHSSKSYPISKVVYTPINSSYSSVLDFSIRNLLFSKPETPKPLLIITPSHVSHIQAAVICSKSHGLQIRTRSGGHDFEGLSYVAYRPFIVVDLINLRSVKVEVENNTAWVESGATLGELYYRIGEKSRTLAFPAGVCPTVGIGGHFSGGGYGLMLRKFGLAADNVIDAYLVDANGKVLDKESMGEDLFWAIRGGGGGSFGIVVAWKIKLVPVPETVTICSTDRNLEEDAIKLIHRWQYVGNKLDENIYLGIILTGGNASTQAGITNPTARFFSLFLGRADELVTTLSTIFPELGLIKQDCVEASWVESTLIIPIGVQPIETLEPLLNRTLTTLDSTKIKSDYITEPIPVAAIKDIWQRLKTQDIETSQLVFVPYGGRMSQISESETPFSHRARYLFKIGYVVGWKDQSLKAKKRHISWLREVYEYMAPFVSKSPRAAYTNYRDLDIGSNNKYGKTSYKRASVWGLKYFGNNFDRLVYVKTKVDPYDFFRHEQSIPTLWSHPQFEK

SEQ ID NO: 84 - DNA, 1827 bp, Artificial Sequence
  CBS99-A0A1S3BDA8- full alpha factor -no signal peptide-strep Tag
  CDS (1)..(1827)
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagctatggcttctccacaaaagtaccaaaatttcttgcagtgcttgtccgaacactcttctaaatcttacccaatctccaaggttgtctataccccaatcaattcctcttactcctctgttttggacttctccattaggaacttgttgttctctaaaccagaaacgccaaagcctttgttgattattactccatctcacgtgtcccatattcaagctgctgttatttgttctaagtcccatggcttgcaaatcagaactagatctggtggtcatgatttcgaaggtttgtcttatgttgcttacagaccattcatcgttgtcgacttgattaacttgagatccgttaaggttgaagtcgaaaacaatactgcttgggttgaatctggtgctactttgggtgagttgtattacagaattggtgaaaagtctaggaccttggcttttccagctggtgtttgtccaactgttggtataggtggtcatttttctggtggtggttatggtttgatgttgagaaaatttggtttggccgctgataacgtcattgatgcttatttggttgatgccaacggtaaggttttggacaaagaatctatgggcgaagatttgttctgggctattagaggtggtggtggcggttcttttggtatagttgttgcttggaagatcaagttggttccagttccagaaactgttactatttgctctaccgacagaaacttggaagaagatgccattaagttgatccacagatggcaatacgttggtaacaaattggacgagaatatctacttgggtatcattttgactggtggtaacgcttctactcaagctggtattactaatccaactgccagattcttcagcttgtttttgggtagagctgatgaattggttactaccttgtctactatcttcccagaattgggtttgatcaagcaagattgtgttgaagcttcttgggtcgaatccactttgattattccaattggtgttcagccaatcgaaaccttggaaccattattgaacagaactttgaccaccttggactccactaagattaagtctgattacatcaccgaacctattccagttgctgctattaaggatatctggcagagattgaaaacccaagacattgaaacctctcagttggtttttgttccatacggtggtagaatgtcccaaatctctgaatctgaaactccattctctcatagagccagatacttgttcaagatcggttatgttgtaggttggaaggaccaatctttgaaggctaagaagagacatatctcctggttgagagaagtttatgagtacatggctccattcgtttctaaatcaccaagagctgcttacaccaattacagagacttggatattggctccaacaacaaatacggtaagacctcttacaagagagcttctgtttggggtttgaagtatttcggtaacaacttcgatagactggtttacgttaagaccaaggttgatccatacgatttcttcagacacgaacaatctattcccaccttgtggtcacatccacaatttgaaaag

SEQ ID NO: 85 - protein, 609 aa, Artificial Sequence
  Synthetic Construct
MRFPSIFTAVLFAASSALAAPVNTTTEDETAQIPAEAVIGYSDLEGDFDVAVLPFSNSTNNGLLFINTTIASIAAKEEGVSLEKREAEAMASPQKYQNFLQCLSEHSSKSYPISKVVYTPINSSYSSVLDFSIRNLLFSKPETPKPLLIITPSHVSHIQAAVICSKSHGLQIRTRSGGHDFEGLSYVAYRPFIVVDLINLRSVKVEVENNTAWVESGATLGELYYRIGEKSRTLAFPAGVCPTVGIGGHFSGGGYGLMLRKFGLAADNVIDAYLVDANGKVLDKESMGEDLFWAIRGGGGGSFGIVVAWKIKLVPVPETVTICSTDRNLEEDAIKLIHRWQYVGNKLDENIYLGIILTGGNASTQAGITNPTARFFSLFLGRADELVTTLSTIFPELGLIKQDCVEASWVESTLIIPIGVQPIETLEPLLNRTLTTLDSTKIKSDYITEPIPVAAIKDIWQRLKTQDIETSQLVFVPYGGRMSQISESETPFSHRARYLFKIGYVVGWKDQSLKAKKRHISWLREVYEYMAPFVSKSPRAAYTNYRDLDIGSNNKYGKTSYKRASVWGLKYFGNNFDRLVYVKTKVDPYDFFRHEQSIPTLWSHPQFEK

SEQ ID NO: 86 - DNA, 1608 bp, Artificial Sequence
  CBS124-A0A1U8FGM5
  CDS (1)..(1608)
atgggtaacttgcaaatcatctgcgtcttgttgttctctttgttcttggctaagtgctactccagagaagatttcttgagatgcttgttcaagtcctccgaatctaacgttactcaaaacatctacaccccaaactcattgacctactcctctattttgaagtacgctcaaaaacactccagatgggttaattcttctcagccaaatttcattgcttctcccacaaaagaatccgaaatcaagccagttattttgtgcgctaagaagttgggtctgcaaatcaaaatcaaatccggtggtcatgattacgagggtatttcttacagatctgaattcccattcgtcatgttggacttgtccaatttgaacaagaccgaaatcgacttgaacgaagaaaccatttgggttcaagctggtgctactttgggtcaactatattacgctattgccaacagatccaacgttcatggttttccaggtggtatttgtttctctgttggtactggtggtttgatttctggtggtggtttaggtactatgatgagaaaatttggtttggccgctgataacgttgttgatgctagagttatggatgtcaacggtaacatcttggaccgtaaaaagatgaagaacgatttgttctgggcaattagaggtggtggtggcgcttcttttggtgttattttggcttggaaattgaagttggttagggttccagaaaaggttactgttttcaccgtctgcaaaaagttcgatgataaccagaacttgatcctgaagtgggaaaacattgctcatcaattgccagataagttggtcatcagagttgttatccaaaacgatggtacaggtaacgataagtacgtcgaaatgagatttcaagccttgtatttgggtccagttgatgaattgatccccttgttgaaagaaaagttcccagaattcgacttggaaaagaaggattgcttgcaagaaccagttggtgatagatctaacagatcctgcattaacaaagaatgcagagaaacctcttggatcggttctgtcttgtacttttacgaaagagaaaccacctcctcattggaggtcttattgaaagaatccattccaaagcagaagtcctactacaaaggtacttctgatttcgtcaagacccagatttctgaatctggttgggaaatggttgaaaggttgttgttggaagaagaatccccaagaattatcttggaaccattaggtggtaagttggacgaaatctccgaatcagaaattccatttccacacagaaaaggcaacttgtacaacatccaatacttggtttactggcacgacaacaacgaaaacgtttcctctcaaaaaattgcctggatgcgtaagctgtacaaagaaatggaaccatacgttgctaactctccaagaactgcttacttgaactacagagatttggacttcggttctaacgatgacaactactcttactccaaagctaaaatctggggcgaaaagtacttcaactacaactttgaaagactggccaaggttaagtctaaggttgatccaaacaacttcttcagaaccgaacaatctattcccttgtaccaaacctac

SEQ ID NO: 87 - protein, 536 aa, Artificial Sequence
  Synthetic Construct
MGNLQIICVLLFSLFLAKCYSREDFLRCLFKSSESNVTQNIYTPNSLTYSSILKYAQKHSRWVNSSQPNFIASPTKESEIKPVILCAKKLGLQIKIKSGGHDYEGISYRSEFPFVMLDLSNLNKTEIDLNEETIWVQAGATLGQLYYAIANRSNVHGFPGGICFSVGTGGLISGGGLGTMMRKFGLAADNVVDARVMDVNGNILDRKKMKNDLFWAIRGGGGASFGVILAWKLKLVRVPEKVTVFTVCKKFDDNQNLILKWENIAHQLPDKLVIRVVIQNDGTGNDKYVEMRFQALYLGPVDELIPLLKEKFPEFDLEKKDCLQEPVGDRSNRSCINKECRETSWIGSVLYFYERETTSSLEVLLKESIPKQKSYYKGTSDFVKTQISESGWEMVERLLLEEESPRIILEPLGGKLDEISESEIPFPHRKGNLYNIQYLVYWHDNNENVSSQKIAWMRKLYKEMEPYVANSPRTAYLNYRDLDFGSNDDNYSYSKAKIWGEKYFNYNFERLAKVKSKVDPNNFFRTEQSIPLYQTY

SEQ ID NO: 88 - DNA, 1551 bp, Artificial Sequence
  CBS124-A0A1U8FGM5-no signal peptide
  CDS (1)..(1551)
atgtccagagaagatttcttgagatgcttgttcaagtcctccgaatctaacgttactcaaaacatctacaccccaaactcattgacctactcctctattttgaagtacgctcaaaaacactccagatgggttaattcttctcagccaaatttcattgcttctcccacaaaagaatccgaaatcaagccagttattttgtgcgctaagaagttgggtctgcaaatcaaaatcaaatccggtggtcatgattacgagggtatttcttacagatctgaattcccattcgtcatgttggacttgtccaatttgaacaagaccgaaatcgacttgaacgaagaaaccatttgggttcaagctggtgctactttgggtcaactatattacgctattgccaacagatccaacgttcatggttttccaggtggtatttgtttctctgttggtactggtggtttgatttctggtggtggtttaggtactatgatgagaaaatttggtttggccgctgataacgttgttgatgctagagttatggatgtcaacggtaacatcttggaccgtaaaaagatgaagaacgatttgttctgggcaattagaggtggtggtggcgcttcttttggtgttattttggcttggaaattgaagttggttagggttccagaaaaggttactgttttcaccgtctgcaaaaagttcgatgataaccagaacttgatcctgaagtgggaaaacattgctcatcaattgccagataagttggtcatcagagttgttatccaaaacgatggtacaggtaacgataagtacgtcgaaatgagatttcaagccttgtatttgggtccagttgatgaattgatccccttgttgaaagaaaagttcccagaattcgacttggaaaagaaggattgcttgcaagaaccagttggtgatagatctaacagatcctgcattaacaaagaatgcagagaaacctcttggatcggttctgtcttgtacttttacgaaagagaaaccacctcctcattggaggtcttattgaaagaatccattccaaagcagaagtcctactacaaaggtacttctgatttcgtcaagacccagatttctgaatctggttgggaaatggttgaaaggttgttgttggaagaagaatccccaagaattatcttggaaccattaggtggtaagttggacgaaatctccgaatcagaaattccatttccacacagaaaaggcaacttgtacaacatccaatacttggtttactggcacgacaacaacgaaaacgtttcctctcaaaaaattgcctggatgcgtaagctgtacaaagaaatggaaccatacgttgctaactctccaagaactgcttacttgaactacagagatttggacttcggttctaacgatgacaactactcttactccaaagctaaaatctggggcgaaaagtacttcaactacaactttgaaagactggccaaggttaagtctaaggttgatccaaacaacttcttcagaaccgaacaatctattcccttgtaccaaacctac

SEQ ID NO: 89 - protein, 517 aa, Artificial Sequence
  Synthetic Construct
MSREDFLRCLFKSSESNVTQNIYTPNSLTYSSILKYAQKHSRWVNSSQPNFIASPTKESEIKPVILCAKKLGLQIKIKSGGHDYEGISYRSEFPFVMLDLSNLNKTEIDLNEETIWVQAGATLGQLYYAIANRSNVHGFPGGICFSVGTGGLISGGGLGTMMRKFGLAADNVVDARVMDVNGNILDRKKMKNDLFWAIRGGGGASFGVILAWKLKLVRVPEKVTVFTVCKKFDDNQNLILKWENIAHQLPDKLVIRVVIQNDGTGNDKYVEMRFQALYLGPVDELIPLLKEKFPEFDLEKKDCLQEPVGDRSNRSCINKECRETSWIGSVLYFYERETTSSLEVLLKESIPKQKSYYKGTSDFVKTQISESGWEMVERLLLEEESPRIILEPLGGKLDEISESEIPFPHRKGNLYNIQYLVYWHDNNENVSSQKIAWMRKLYKEMEPYVANSPRTAYLNYRDLDFGSNDDNYSYSKAKIWGEKYFNYNFERLAKVKSKVDPNNFFRTEQSIPLYQTY

SEQ ID NO: 90 - DNA, 1575 bp, Artificial Sequence
  CBS124-A0A1U8FGM5-no signal peptide-strep Tag
  CDS (1)..(1575)
atgtccagagaagatttcttgagatgcttgttcaagtcctccgaatctaacgttactcaaaacatctacaccccaaactcattgacctactcctctattttgaagtacgctcaaaaacactccagatgggttaattcttctcagccaaatttcattgcttctcccacaaaagaatccgaaatcaagccagttattttgtgcgctaagaagttgggtctgcaaatcaaaatcaaatccggtggtcatgattacgagggtatttcttacagatctgaattcccattcgtcatgttggacttgtccaatttgaacaagaccgaaatcgacttgaacgaagaaaccatttgggttcaagctggtgctactttgggtcaactatattacgctattgccaacagatccaacgttcatggttttccaggtggtatttgtttctctgttggtactggtggtttgatttctggtggtggtttaggtactatgatgagaaaatttggtttggccgctgataacgttgttgatgctagagttatggatgtcaacggtaacatcttggaccgtaaaaagatgaagaacgatttgttctgggcaattagaggtggtggtggcgcttcttttggtgttattttggcttggaaattgaagttggttagggttccagaaaaggttactgttttcaccgtctgcaaaaagttcgatgataaccagaacttgatcctgaagtgggaaaacattgctcatcaattgccagataagttggtcatcagagttgttatccaaaacgatggtacaggtaacgataagtacgtcgaaatgagatttcaagccttgtatttgggtccagttgatgaattgatccccttgttgaaagaaaagttcccagaattcgacttggaaaagaaggattgcttgcaagaaccagttggtgatagatctaacagatcctgcattaacaaagaatgcagagaaacctcttggatcggttctgtcttgtacttttacgaaagagaaaccacctcctcattggaggtcttattgaaagaatccattccaaagcagaagtcctactacaaaggtacttctgatttcgtcaagacccagatttctgaatctggttgggaaatggttgaaaggttgttgttggaagaagaatccccaagaattatcttggaaccattaggtggtaagttggacgaaatctccgaatcagaaattccatttccacacagaaaaggcaacttgtacaacatccaatacttggtttactggcacgacaacaacgaaaacgtttcctctcaaaaaattgcctggatgcgtaagctgtacaaagaaatggaaccatacgttgctaactctccaagaactgcttacttgaactacagagatttggacttcggttctaacgatgacaactactcttactccaaagctaaaatctggggcgaaaagtacttcaactacaactttgaaagactggccaaggttaagtctaaggttgatccaaacaacttcttcagaaccgaacaatctattcccttgtaccaaacctactggtcacatccacaatttgaaaag

SEQ ID NO: 91 - protein, 525 aa, Artificial Sequence
  Synthetic Construct
MSREDFLRCLFKSSESNVTQNIYTPNSLTYSSILKYAQKHSRWVNSSQPNFIASPTKESEIKPVILCAKKLGLQIKIKSGGHDYEGISYRSEFPFVMLDLSNLNKTEIDLNEETIWVQAGATLGQLYYAIANRSNVHGFPGGICFSVGTGGLISGGGLGTMMRKFGLAADNVVDARVMDVNGNILDRKKMKNDLFWAIRGGGGASFGVILAWKLKLVRVPEKVTVFTVCKKFDDNQNLILKWENIAHQLPDKLVIRVVIQNDGTGNDKYVEMRFQALYLGPVDELIPLLKEKFPEFDLEKKDCLQEPVGDRSNRSCINKECRETSWIGSVLYFYERETTSSLEVLLKESIPKQKSYYKGTSDFVKTQISESGWEMVERLLLEEESPRIILEPLGGKLDEISESEIPFPHRKGNLYNIQYLVYWHDNNENVSSQKIAWMRKLYKEMEPYVANSPRTAYLNYRDLDFGSNDDNYSYSKAKIWGEKYFNYNFERLAKVKSKVDPNNFFRTEQSIPLYQTYWSHPQFEK

SEQ ID NO: 92 - DNA, 1632 bp, Artificial Sequence
  CBS124-A0A1U8FGM5- truncated alpha factor - no signal peptide-strep Tag
  CDS (1)..(1632)
atgagatttccttccatcttcacggctgtgctatttgcagcatcctccgcacttgcaatgtccagagaagatttcttgagatgcttgttcaagtcctccgaatctaacgttactcaaaacatctacaccccaaactcattgacctactcctctattttgaagtacgctcaaaaacactccagatgggttaattcttctcagccaaatttcattgcttctcccacaaaagaatccgaaatcaagccagttattttgtgcgctaagaagttgggtctgcaaatcaaaatcaaatccggtggtcatgattacgagggtatttcttacagatctgaattcccattcgtcatgttggacttgtccaatttgaacaagaccgaaatcgacttgaacgaagaaaccatttgggttcaagctggtgctactttgggtcaactatattacgctattgccaacagatccaacgttcatggttttccaggtggtatttgtttctctgttggtactggtggtttgatttctggtggtggtttaggtactatgatgagaaaatttggtttggccgctgataacgttgttgatgctagagttatggatgtcaacggtaacatcttggaccgtaaaaagatgaagaacgatttgttctgggcaattagaggtggtggtggcgcttcttttggtgttattttggcttggaaattgaagttggttagggttccagaaaaggttactgttttcaccgtctgcaaaaagttcgatgataaccagaacttgatcctgaagtgggaaaacattgctcatcaattgccagataagttggtcatcagagttgttatccaaaacgatggtacaggtaacgataagtacgtcgaaatgagatttcaagccttgtatttgggtccagttgatgaattgatccccttgttgaaagaaaagttcccagaattcgacttggaaaagaaggattgcttgcaagaaccagttggtgatagatctaacagatcctgcattaacaaagaatgcagagaaacctcttggatcggttctgtcttgtacttttacgaaagagaaaccacctcctcattggaggtcttattgaaagaatccattccaaagcagaagtcctactacaaaggtacttctgatttcgtcaagacccagatttctgaatctggttgggaaatggttgaaaggttgttgttggaagaagaatccccaagaattatcttggaaccattaggtggtaagttggacgaaatctccgaatcagaaattccatttccacacagaaaaggcaacttgtacaacatccaatacttggtttactggcacgacaacaacgaaaacgtttcctctcaaaaaattgcctggatgcgtaagctgtacaaagaaatggaaccatacgttgctaactctccaagaactgcttacttgaactacagagatttggacttcggttctaacgatgacaactactcttactccaaagctaaaatctggggcgaaaagtacttcaactacaactttgaaagactggccaaggttaagtctaaggttgatccaaacaacttcttcagaaccgaacaatctattcccttgtaccaaacctactggtcacatccacaatttgaaaag

SEQ ID NO: 93 - protein, 544 aa, Artificial Sequence
  Synthetic Construct
MRFPSIFTAVLFAASSALAMSREDFLRCLFKSSESNVTQNIYTPNSLTYSSILKYAQKHSRWVNSSQPNFIASPTKESEIKPVILCAKKLGLQIKIKSGGHDYEGISYRSEFPFVMLDLSNLNKTEIDLNEETIWVQAGATLGQLYYAIANRSNVHGFPGGICFSVGTGGLISGGGLGTMMRKFGLAADNVVDARVMDVNGNILDRKKMKNDLFWAIRGGGGASFGVILAWKLKLVRVPEKVTVFTVCKKFDDNQNLILKWENIAHQLPDKLVIRVVIQNDGTGNDKYVEMRFQALYLGPVDELIPLLKEKFPEFDLEKKDCLQEPVGDRSNRSCINKECRETSWIGSVLYFYERETTSSLEVLLKESIPKQKSYYKGTSDFVKTQISESGWEMVERLLLEEESPRIILEPLGGKLDEISESEIPFPHRKGNLYNIQYLVYWHDNNENVSSQKIAWMRKLYKEMEPYVANSPRTAYLNYRDLDFGSNDDNYSYSKAKIWGEKYFNYNFERLAKVKSKVDPNNFFRTEQSIPLYQTYWSHPQFEK

SEQ ID NO: 94 - DNA, 1842 bp, Artificial Sequence
  CBS124-A0A1U8FGM5- full alpha factor -no signal peptide-strep Tag
  CDS (1)..(1842)
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagctatgtccagagaagatttcttgagatgcttgttcaagtcctccgaatctaacgttactcaaaacatctacaccccaaactcattgacctactcctctattttgaagtacgctcaaaaacactccagatgggttaattcttctcagccaaatttcattgcttctcccacaaaagaatccgaaatcaagccagttattttgtgcgctaagaagttgggtctgcaaatcaaaatcaaatccggtggtcatgattacgagggtatttcttacagatctgaattcccattcgtcatgttggacttgtccaatttgaacaagaccgaaatcgacttgaacgaagaaaccatttgggttcaagctggtgctactttgggtcaactatattacgctattgccaacagatccaacgttcatggttttccaggtggtatttgtttctctgttggtactggtggtttgatttctggtggtggtttaggtactatgatgagaaaatttggtttggccgctgataacgttgttgatgctagagttatggatgtcaacggtaacatcttggaccgtaaaaagatgaagaacgatttgttctgggcaattagaggtggtggtggcgcttcttttggtgttattttggcttggaaattgaagttggttagggttccagaaaaggttactgttttcaccgtctgcaaaaagttcgatgataaccagaacttgatcctgaagtgggaaaacattgctcatcaattgccagataagttggtcatcagagttgttatccaaaacgatggtacaggtaacgataagtacgtcgaaatgagatttcaagccttgtatttgggtccagttgatgaattgatccccttgttgaaagaaaagttcccagaattcgacttggaaaagaaggattgcttgcaagaaccagttggtgatagatctaacagatcctgcattaacaaagaatgcagagaaacctcttggatcggttctgtcttgtacttttacgaaagagaaaccacctcctcattggaggtcttattgaaagaatccattccaaagcagaagtcctactacaaaggtacttctgatttcgtcaagacccagatttctgaatctggttgggaaatggttgaaaggttgttgttggaagaagaatccccaagaattatcttggaaccattaggtggtaagttggacgaaatctccgaatcagaaattccatttccacacagaaaaggcaacttgtacaacatccaatacttggtttactggcacgacaacaacgaaaacgtttcctctcaaaaaattgcctggatgcgtaagctgtacaaagaaatggaaccatacgttgctaactctccaagaactgcttacttgaactacagagatttggacttcggttctaacgatgacaactactcttactccaaagctaaaatctggggcgaaaagtacttcaactacaactttgaaagactggccaaggttaagtctaaggttgatccaaacaacttcttcagaaccgaacaatctattcccttgtaccaaacctactggtcacatccacaatttgaaaag

SEQ ID NO: 95 - protein, 614 aa, Artificial Sequence
  Synthetic Construct
MRFPSIFTAVLFAASSALAAPVNTTTEDETAQIPAEAVIGYSDLEGDFDVAVLPFSNSTNNGLLFINTTIASIAAKEEGVSLEKREAEAMSREDFLRCLFKSSESNVTQNIYTPNSLTYSSILKYAQKHSRWVNSSQPNFIASPTKESEIKPVILCAKKLGLQIKIKSGGHDYEGISYRSEFPFVMLDLSNLNKTEIDLNEETIWVQAGATLGQLYYAIANRSNVHGFPGGICFSVGTGGLISGGGLGTMMRKFGLAADNVVDARVMDVNGNILDRKKMKNDLFWAIRGGGGASFGVILAWKLKLVRVPEKVTVFTVCKKFDDNQNLILKWENIAHQLPDKLVIRVVIQNDGTGNDKYVEMRFQALYLGPVDELIPLLKEKFPEFDLEKKDCLQEPVGDRSNRSCINKECRETSWIGSVLYFYERETTSSLEVLLKESIPKQKSYYKGTSDFVKTQISESGWEMVERLLLEEESPRIILEPLGGKLDEISESEIPFPHRKGNLYNIQYLVYWHDNNENVSSQKIAWMRKLYKEMEPYVANSPRTAYLNYRDLDFGSNDDNYSYSKAKIWGEKYFNYNFERLAKVKSKVDPNNFFRTEQSIPLYQTYWSHPQFEK

SEQ ID NO: 96 - DNA, 1641 bp, Artificial Sequence
  CBS133-A0A1U8MHW2
  CDS (1)..(1641)
atgttcccattcttgttcgtcgtcttgttgtctttgtcttggagaatcaatgcttctgctttgccagttcaagaattcctacattgcttgtctttgagatccccaaactcttctattgccaagttggtctatacccagaacaactcttcttactcctctgttttgaaatccgctgctcaaaacttcagattcactactccatctactccaactccattggctatagttactccattgcatgcctctcatattcaagctgctgtttactgttgtagaaaacacggtttacaagtcagaactagatctggtggtcatgattttgaaggtttgtcttacacttccgcttacaaggttccattcgttgttatcgatttggtcaacttgagatccgttagagttaacgttgaaaaagctactgcttgggttgaatctggtgctactgttggtgaattatacgacgaaattgccagaaagtctaagaccttgggttttccagctggtatttgtccaactttaggtgttggtggtcacttgtctggtggtggttatggtttgttgtttagaaagtatggtttgggtgccgataacgtcattgatgctagattgattgatgtcaagggtcgtatcttggacaaaaagtctatgggtgaagatttgttttgggccattagaggtggtggtggcggtacttttggtatagttttggcttggaaattgaagttggttgctgttccagctaacgttactgttttcactgttagaaagactttggaacaaaacgccactaagttggttcatagatggcaatctattgcccacaagttcccaaaagaaatgcacttgtctattgctattgctagggctaactcttccgaagatgaagaaaagatgactatccaagcttctttcacctctactttcttgggttccattgatgaattgatcccattgatggaagaaaagttcccagaattgggtttagtcaaagaagattgcctagaaatgtcttgggctgagtctaacttgtacagctttttgttcttgctgagatctccatctgaaaccctgttgaatagaaaccagaagtcctctatctccaaaacctttttcaaggccaagtccgattttgtcaaacagccaattccagaatctgctttcgaaggtttatggtccaagttttatgaagatgaggctaagtccgccatcatggtttttgttgcttttggtggtaagatggacgaaatcttggaaactgaatacccatatccacatagagccggtaacttatacactatcttgtacactgttgactgggaagagaaagagaacatcaactctgaaaagttcatgtcctggatgagaagagtctacaattacatgactccctacgtttctaagtctccaagagaagcttacatcaactacagagatttggacatcggtacaaacaagatcaacaacagaaagagatcttacgctaaggctagagtatggggtgttaagtactttaagaacaacttcaacaggctggttaacgtcaagactatagttgacccacagaatttcttcagacacgaacaatctattccaccactattcttgtcctggaaaagatccgatcataagaagcacttgtcctcc

SEQ ID NO: 97 - protein, 547 aa, Artificial Sequence
  Synthetic Construct
MFPFLFVVLLSLSWRINASALPVQEFLHCLSLRSPNSSIAKLVYTQNNSSYSSVLKSAAQNFRFTTPSTPTPLAIVTPLHASHIQAAVYCCRKHGLQVRTRSGGHDFEGLSYTSAYKVPFVVIDLVNLRSVRVNVEKATAWVESGATVGELYDEIARKSKTLGFPAGICPTLGVGGHLSGGGYGLLFRKYGLGADNVIDARLIDVKGRILDKKSMGEDLFWAIRGGGGGTFGIVLAWKLKLVAVPANVTVFTVRKTLEQNATKLVHRWQSIAHKFPKEMHLSIAIARANSSEDEEKMTIQASFTSTFLGSIDELIPLMEEKFPELGLVKEDCLEMSWAESNLYSFLFLLRSPSETLLNRNQKSSISKTFFKAKSDFVKQPIPESAFEGLWSKFYEDEAKSAIMVFVAFGGKMDEILETEYPYPHRAGNLYTILYTVDWEEKENINSEKFMSWMRRVYNYMTPYVSKSPREAYINYRDLDIGTNKINNRKRSYAKARVWGVKYFKNNFNRLVNVKTIVDPQNFFRHEQSIPPLFLSWKRSDHKKHLSS

SEQ ID NO: 98 - DNA, 1587 bp, Artificial Sequence
  CBS133-A0A1U8MHW2- no signal peptide
  CDS (1)..(1587)
atggctttgccagttcaagaattcctacattgcttgtctttgagatccccaaactcttctattgccaagttggtctatacccagaacaactcttcttactcctctgttttgaaatccgctgctcaaaacttcagattcactactccatctactccaactccattggctatagttactccattgcatgcctctcatattcaagctgctgtttactgttgtagaaaacacggtttacaagtcagaactagatctggtggtcatgattttgaaggtttgtcttacacttccgcttacaaggttccattcgttgttatcgatttggtcaacttgagatccgttagagttaacgttgaaaaagctactgcttgggttgaatctggtgctactgttggtgaattatacgacgaaattgccagaaagtctaagaccttgggttttccagctggtatttgtccaactttaggtgttggtggtcacttgtctggtggtggttatggtttgttgtttagaaagtatggtttgggtgccgataacgtcattgatgctagattgattgatgtcaagggtcgtatcttggacaaaaagtctatgggtgaagatttgttttgggccattagaggtggtggtggcggtacttttggtatagttttggcttggaaattgaagttggttgctgttccagctaacgttactgttttcactgttagaaagactttggaacaaaacgccactaagttggttcatagatggcaatctattgcccacaagttcccaaaagaaatgcacttgtctattgctattgctagggctaactcttccgaagatgaagaaaagatgactatccaagcttctttcacctctactttcttgggttccattgatgaattgatcccattgatggaagaaaagttcccagaattgggtttagtcaaagaagattgcctagaaatgtcttgggctgagtctaacttgtacagctttttgttcttgctgagatctccatctgaaaccctgttgaatagaaaccagaagtcctctatctccaaaacctttttcaaggccaagtccgattttgtcaaacagccaattccagaatctgctttcgaaggtttatggtccaagttttatgaagatgaggctaagtccgccatcatggtttttgttgcttttggtggtaagatggacgaaatcttggaaactgaatacccatatccacatagagccggtaacttatacactatcttgtacactgttgactgggaagagaaagagaacatcaactctgaaaagttcatgtcctggatgagaagagtctacaattacatgactccctacgtttctaagtctccaagagaagcttacatcaactacagagatttggacatcggtacaaacaagatcaacaacagaaagagatcttacgctaaggctagagtatggggtgttaagtactttaagaacaacttcaacaggctggttaacgtcaagactatagttgacccacagaatttcttcagacacgaacaatctattccaccactattcttgtcctggaaaagatccgatcataagaagcacttgtcctcc

SEQ ID NO: 99 - protein, 529 aa, Artificial Sequence
  Synthetic Construct
MALPVQEFLHCLSLRSPNSSIAKLVYTQNNSSYSSVLKSAAQNFRFTTPSTPTPLAIVTPLHASHIQAAVYCCRKHGLQVRTRSGGHDFEGLSYTSAYKVPFVVIDLVNLRSVRVNVEKATAWVESGATVGELYDEIARKSKTLGFPAGICPTLGVGGHLSGGGYGLLFRKYGLGADNVIDARLIDVKGRILDKKSMGEDLFWAIRGGGGGTFGIVLAWKLKLVAVPANVTVFTVRKTLEQNATKLVHRWQSIAHKFPKEMHLSIAIARANSSEDEEKMTIQASFTSTFLGSIDELIPLMEEKFPELGLVKEDCLEMSWAESNLYSFLFLLRSPSETLLNRNQKSSISKTFFKAKSDFVKQPIPESAFEGLWSKFYEDEAKSAIMVFVAFGGKMDEILETEYPYPHRAGNLYTILYTVDWEEKENINSEKFMSWMRRVYNYMTPYVSKSPREAYINYRDLDIGTNKINNRKRSYAKARVWGVKYFKNNFNRLVNVKTIVDPQNFFRHEQSIPPLFLSWKRSDHKKHLSS

SEQ ID NO: 100 - DNA, 1611 bp, Artificial Sequence
  CBS133-A0A1U8MHW2- no signal peptide-strep Tag
  CDS (1)..(1611)
atggctttgccagttcaagaattcctacattgcttgtctttgagatccccaaactcttctattgccaagttggtctatacccagaacaactcttcttactcctctgttttgaaatccgctgctcaaaacttcagattcactactccatctactccaactccattggctatagttactccattgcatgcctctcatattcaagctgctgtttactgttgtagaaaacacggtttacaagtcagaactagatctggtggtcatgattttgaaggtttgtcttacacttccgcttacaaggttccattcgttgttatcgatttggtcaacttgagatccgttagagttaacgttgaaaaagctactgcttgggttgaatctggtgctactgttggtgaattatacgacgaaattgccagaaagtctaagaccttgggttttccagctggtatttgtccaactttaggtgttggtggtcacttgtctggtggtggttatggtttgttgtttagaaagtatggtttgggtgccgataacgtcattgatgctagattgattgatgtcaagggtcgtatcttggacaaaaagtctatgggtgaagatttgttttgggccattagaggtggtggtggcggtacttttggtatagttttggcttggaaattgaagttggttgctgttccagctaacgttactgttttcactgttagaaagactttggaacaaaacgccactaagttggttcatagatggcaatctattgcccacaagttcccaaaagaaatgcacttgtctattgctattgctagggctaactcttccgaagatgaagaaaagatgactatccaagcttctttcacctctactttcttgggttccattgatgaattgatcccattgatggaagaaaagttcccagaattgggtttagtcaaagaagattgcctagaaatgtcttgggctgagtctaacttgtacagctttttgttcttgctgagatctccatctgaaaccctgttgaatagaaaccagaagtcctctatctccaaaacctttttcaaggccaagtccgattttgtcaaacagccaattccagaatctgctttcgaaggtttatggtccaagttttatgaagatgaggctaagtccgccatcatggtttttgttgcttttggtggtaagatggacgaaatcttggaaactgaatacccatatccacatagagccggtaacttatacactatcttgtacactgttgactgggaagagaaagagaacatcaactctgaaaagttcatgtcctggatgagaagagtctacaattacatgactccctacgtttctaagtctccaagagaagcttacatcaactacagagatttggacatcggtacaaacaagatcaacaacagaaagagatcttacgctaaggctagagtatggggtgttaagtactttaagaacaacttcaacaggctggttaacgtcaagactatagttgacccacagaatttcttcagacacgaacaatctattccaccactattcttgtcctggaaaagatccgatcataagaagcacttgtcctcctggtcacatccacaatttgaaaag

SEQ ID NO: 101 - protein, 537 aa, Artificial Sequence
  Synthetic Construct
MALPVQEFLHCLSLRSPNSSIAKLVYTQNNSSYSSVLKSAAQNFRFTTPSTPTPLAIVTPLHASHIQAAVYCCRKHGLQVRTRSGGHDFEGLSYTSAYKVPFVVIDLVNLRSVRVNVEKATAWVESGATVGELYDEIARKSKTLGFPAGICPTLGVGGHLSGGGYGLLFRKYGLGADNVIDARLIDVKGRILDKKSMGEDLFWAIRGGGGGTFGIVLAWKLKLVAVPANVTVFTVRKTLEQNATKLVHRWQSIAHKFPKEMHLSIAIARANSSEDEEKMTIQASFTSTFLGSIDELIPLMEEKFPELGLVKEDCLEMSWAESNLYSFLFLLRSPSETLLNRNQKSSISKTFFKAKSDFVKQPIPESAFEGLWSKFYEDEAKSAIMVFVAFGGKMDEILETEYPYPHRAGNLYTILYTVDWEEKENINSEKFMSWMRRVYNYMTPYVSKSPREAYINYRDLDIGTNKINNRKRSYAKARVWGVKYFKNNFNRLVNVKTIVDPQNFFRHEQSIPPLFLSWKRSDHKKHLSSWSHPQFEK

SEQ ID NO: 102 - DNA, 1668 bp, Artificial Sequence
  CBS133-A0A1U8MHW2-truncated alpha factor - no signal peptide-strep Tag
  CDS (1)..(1668)
atgagatttccttccatcttcacggctgtgctatttgcagcatcctccgcacttgcaatggctttgccagttcaagaattcctacattgcttgtctttgagatccccaaactcttctattgccaagttggtctatacccagaacaactcttcttactcctctgttttgaaatccgctgctcaaaacttcagattcactactccatctactccaactccattggctatagttactccattgcatgcctctcatattcaagctgctgtttactgttgtagaaaacacggtttacaagtcagaactagatctggtggtcatgattttgaaggtttgtcttacacttccgcttacaaggttccattcgttgttatcgatttggtcaacttgagatccgttagagttaacgttgaaaaagctactgcttgggttgaatctggtgctactgttggtgaattatacgacgaaattgccagaaagtctaagaccttgggttttccagctggtatttgtccaactttaggtgttggtggtcacttgtctggtggtggttatggtttgttgtttagaaagtatggtttgggtgccgataacgtcattgatgctagattgattgatgtcaagggtcgtatcttggacaaaaagtctatgggtgaagatttgttttgggccattagaggtggtggtggcggtacttttggtatagttttggcttggaaattgaagttggttgctgttccagctaacgttactgttttcactgttagaaagactttggaacaaaacgccactaagttggttcatagatggcaatctattgcccacaagttcccaaaagaaatgcacttgtctattgctattgctagggctaactcttccgaagatgaagaaaagatgactatccaagcttctttcacctctactttcttgggttccattgatgaattgatcccattgatggaagaaaagttcccagaattgggtttagtcaaagaagattgcctagaaatgtcttgggctgagtctaacttgtacagctttttgttcttgctgagatctccatctgaaaccctgttgaatagaaaccagaagtcctctatctccaaaacctttttcaaggccaagtccgattttgtcaaacagccaattccagaatctgctttcgaaggtttatggtccaagttttatgaagatgaggctaagtccgccatcatggtttttgttgcttttggtggtaagatggacgaaatcttggaaactgaatacccatatccacatagagccggtaacttatacactatcttgtacactgttgactgggaagagaaagagaacatcaactctgaaaagttcatgtcctggatgagaagagtctacaattacatgactccctacgtttctaagtctccaagagaagcttacatcaactacagagatttggacatcggtacaaacaagatcaacaacagaaagagatcttacgctaaggctagagtatggggtgttaagtactttaagaacaacttcaacaggctggttaacgtcaagactatagttgacccacagaatttcttcagacacgaacaatctattccaccactattcttgtcctggaaaagatccgatcataagaagcacttgtcctcctggtcacatccacaatttgaaaag

SEQ ID NO: 103 - protein, 556 aa, Artificial Sequence
  Synthetic Construct
MRFPSIFTAVLFAASSALAMALPVQEFLHCLSLRSPNSSIAKLVYTQNNSSYSSVLKSAAQNFRFTTPSTPTPLAIVTPLHASHIQAAVYCCRKHGLQVRTRSGGHDFEGLSYTSAYKVPFVVIDLVNLRSVRVNVEKATAWVESGATVGELYDEIARKSKTLGFPAGICPTLGVGGHLSGGGYGLLFRKYGLGADNVIDARLIDVKGRILDKKSMGEDLFWAIRGGGGGTFGIVLAWKLKLVAVPANVTVFTVRKTLEQNATKLVHRWQSIAHKFPKEMHLSIAIARANSSEDEEKMTIQASFTSTFLGSIDELIPLMEEKFPELGLVKEDCLEMSWAESNLYSFLFLLRSPSETLLNRNQKSSISKTFFKAKSDFVKQPIPESAFEGLWSKFYEDEAKSAIMVFVAFGGKMDEILETEYPYPHRAGNLYTILYTVDWEEKENINSEKFMSWMRRVYNYMTPYVSKSPREAYINYRDLDIGTNKINNRKRSYAKARVWGVKYFKNNFNRLVNVKTIVDPQNFFRHEQSIPPLFLSWKRSDHKKHLSSWSHPQFEK

SEQ ID NO: 104 - DNA, 1878 bp, Artificial Sequence
  CBS133-A0A1U8MHW2-full alpha factor -no signal peptide-strep Tag
  CDS (1)..(1878)
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagctatggctttgccagttcaagaattcctacattgcttgtctttgagatccccaaactcttctattgccaagttggtctatacccagaacaactcttcttactcctctgttttgaaatccgctgctcaaaacttcagattcactactccatctactccaactccattggctatagttactccattgcatgcctctcatattcaagctgctgtttactgttgtagaaaacacggtttacaagtcagaactagatctggtggtcatgattttgaaggtttgtcttacacttccgcttacaaggttccattcgttgttatcgatttggtcaacttgagatccgttagagttaacgttgaaaaagctactgcttgggttgaatctggtgctactgttggtgaattatacgacgaaattgccagaaagtctaagaccttgggttttccagctggtatttgtccaactttaggtgttggtggtcacttgtctggtggtggttatggtttgttgtttagaaagtatggtttgggtgccgataacgtcattgatgctagattgattgatgtcaagggtcgtatcttggacaaaaagtctatgggtgaagatttgttttgggccattagaggtggtggtggcggtacttttggtatagttttggcttggaaattgaagttggttgctgttccagctaacgttactgttttcactgttagaaagactttggaacaaaacgccactaagttggttcatagatggcaatctattgcccacaagttcccaaaagaaatgcacttgtctattgctattgctagggctaactcttccgaagatgaagaaaagatgactatccaagcttctttcacctctactttcttgggttccattgatgaattgatcccattgatggaagaaaagttcccagaattgggtttagtcaaagaagattgcctagaaatgtcttgggctgagtctaacttgtacagctttttgttcttgctgagatctccatctgaaaccctgttgaatagaaaccagaagtcctctatctccaaaacctttttcaaggccaagtccgattttgtcaaacagccaattccagaatctgctttcgaaggtttatggtccaagttttatgaagatgaggctaagtccgccatcatggtttttgttgcttttggtggtaagatggacgaaatcttggaaactgaatacccatatccacatagagccggtaacttatacactatcttgtacactgttgactgggaagagaaagagaacatcaactctgaaaagttcatgtcctggatgagaagagtctacaattacatgactccctacgtttctaagtctccaagagaagcttacatcaactacagagatttggacatcggtacaaacaagatcaacaacagaaagagatcttacgctaaggctagagtatggggtgttaagtactttaagaacaacttcaacaggctggttaacgtcaagactatagttgacccacagaatttcttcagacacgaacaatctattccaccactattcttgtcctggaaaagatccgatcataagaagcacttgtcctcctggtcacatccacaatttgaaaag

SEQ ID NO: 105 - protein, 626 aa, Artificial Sequence
  Synthetic Construct
MRFPSIFTAVLFAASSALAAPVNTTTEDETAQIPAEAVIGYSDLEGDFDVAVLPFSNSTNNGLLFINTTIASIAAKEEGVSLEKREAEAMALPVQEFLHCLSLRSPNSSIAKLVYTQNNSSYSSVLKSAAQNFRFTTPSTPTPLAIVTPLHASHIQAAVYCCRKHGLQVRTRSGGHDFEGLSYTSAYKVPFVVIDLVNLRSVRVNVEKATAWVESGATVGELYDEIARKSKTLGFPAGICPTLGVGGHLSGGGYGLLFRKYGLGADNVIDARLIDVKGRILDKKSMGEDLFWAIRGGGGGTFGIVLAWKLKLVAVPANVTVFTVRKTLEQNATKLVHRWQSIAHKFPKEMHLSIAIARANSSEDEEKMTIQASFTSTFLGSIDELIPLMEEKFPELGLVKEDCLEMSWAESNLYSFLFLLRSPSETLLNRNQKSSISKTFFKAKSDFVKQPIPESAFEGLWSKFYEDEAKSAIMVFVAFGGKMDEILETEYPYPHRAGNLYTILYTVDWEEKENINSEKFMSWMRRVYNYMTPYVSKSPREAYINYRDLDIGTNKINNRKRSYAKARVWGVKYFKNNFNRLVNVKTIVDPQNFFRHEQSIPPLFLSWKRSDHKKHLSSWSHPQFEK

SEQ ID NO: 106 - DNA, 1638 bp, Artificial Sequence
  CBS134-A0A1J3CT99
  CDS (1)..(1638)
atgaggatctctaagccaattccagtcatctcctacattttgttcttggcccaatacttctcattgcacacaaaagaacctacctcttctacctcattgcaagatgatttcatcaagtgcttgcacagaaacaccaatgttgatttcccattggacaagactttcttcactccacaaagaaactcctccaacttcaaagaagttttgaacaccaccgtctggaatcaaagatatatgactaagtctatgcccaagccagagttcatttttaagccagttcatgaatcccatgtccaagcctctattatttgctctaagaagttgagaatccacttcagagttagatctggtggtcatgattatgagggtttgtcttacgtttctcaaatggaaactccattcgtcttgatcgatttgtggaagttgaagcaaatcaacgtcgacatcgaagataattctgcttgggttcaagctggtgctactactggtgagttgtattatagaattgctgccaagtctaaggttcatggttttccagctggtttgtgttctactgttggtataggtggtcatatcactggtggtggttatggtactttgatgagaaagtatggtttgtccaccgataacgttttggatgctagaatcgttgatgctaatggtcagttgttgaacagaactgctatgggtgaagatttgttctgggctattagaggtggtggtggcggttcatttggtgttattttggcttggaagatcaagttggttccagttccagaaactttgaccattttcactattaccaagaccttggaacaagatgccggtttcaagattttgtctaagtggcaaagaatcgtcgacaagttggtagaagaattgtccatcagagtcttgttcagaaacactggtaacaagactgttactactacctacagaggtgaattcttgggtgaaaaaggtacattgatggaagtcatgaagaagtgctttccagaattgggtttgactcaagaggattgcattgaaatgtcttggatcgaaactgttgtcaacaatgctggttttactactagaccacctccaccattggaaattttgttgcaaccatcttctccatacggtagaccatacttcaaagctaagtctgatttcgtcaaagaacccattccagttttgggtttaaagggtatgttcaagagaatgatcgaagaggatgcctctttcttgatttggaaaccatacggtggtatgatggctagaattccagaatccgaaattccatttccacacagaaacggtactatcttcaagatccattacttcaccaagtggtctgaaaacggttcttcttctgatgacaaacacatgaagtggatcagggaactgtattcttatatgaccccatacgtttcttctaacccaagacaagcttacgttaactacagagatttggacatcggtcagaacaagaagaatgactctgaagataactttagaagggctcaaatttggggtgctaagtactttaagaacaacttcaacaggctggtcaagatcaagacaaaagttgatccagaaaacttgttcaggcacgaacaatctattccaccattaccaattagaaggcagacctct

SEQ ID NO: 107 - protein, 546 aa, Artificial Sequence
  Synthetic Construct
MRISKPIPVISYILFLAQYFSLHTKEPTSSTSLQDDFIKCLHRNTNVDFPLDKTFFTPQRNSSNFKEVLNTTVWNQRYMTKSMPKPEFIFKPVHESHVQASIICSKKLRIHFRVRSGGHDYEGLSYVSQMETPFVLIDLWKLKQINVDIEDNSAWVQAGATTGELYYRIAAKSKVHGFPAGLCSTVGIGGHITGGGYGTLMRKYGLSTDNVLDARIVDANGQLLNRTAMGEDLFWAIRGGGGGSFGVILAWKIKLVPVPETLTIFTITKTLEQDAGFKILSKWQRIVDKLVEELSIRVLFRNTGNKTVTTTYRGEFLGEKGTLMEVMKKCFPELGLTQEDCIEMSWIETVVNNAGFTTRPPPPLEILLQPSSPYGRPYFKAKSDFVKEPIPVLGLKGMFKRMIEEDASFLIWKPYGGMMARIPESEIPFPHRNGTIFKIHYFTKWSENGSSSDDKHMKWIRELYSYMTPYVSSNPRQAYVNYRDLDIGQNKKNDSEDNFRRAQIWGAKYFKNNFNRLVKIKTKVDPENLFRHEQSIPPLPIRRQTS

SEQ ID NO: 108 - DNA, 1569 bp, Artificial Sequence
  CBS134-A0A1J3CT99- no signal peptide
  CDS (1)..(1569)
atgaaagaacctacctcttctacctcattgcaagatgatttcatcaagtgcttgcacagaaacaccaatgttgatttcccattggacaagactttcttcactccacaaagaaactcctccaacttcaaagaagttttgaacaccaccgtctggaatcaaagatatatgactaagtctatgcccaagccagagttcatttttaagccagttcatgaatcccatgtccaagcctctattatttgctctaagaagttgagaatccacttcagagttagatctggtggtcatgattatgagggtttgtcttacgtttctcaaatggaaactccattcgtcttgatcgatttgtggaagttgaagcaaatcaacgtcgacatcgaagataattctgcttgggttcaagctggtgctactactggtgagttgtattatagaattgctgccaagtctaaggttcatggttttccagctggtttgtgttctactgttggtataggtggtcatatcactggtggtggttatggtactttgatgagaaagtatggtttgtccaccgataacgttttggatgctagaatcgttgatgctaatggtcagttgttgaacagaactgctatgggtgaagatttgttctgggctattagaggtggtggtggcggttcatttggtgttattttggcttggaagatcaagttggttccagttccagaaactttgaccattttcactattaccaagaccttggaacaagatgccggtttcaagattttgtctaagtggcaaagaatcgtcgacaagttggtagaagaattgtccatcagagtcttgttcagaaacactggtaacaagactgttactactacctacagaggtgaattcttgggtgaaaaaggtacattgatggaagtcatgaagaagtgctttccagaattgggtttgactcaagaggattgcattgaaatgtcttggatcgaaactgttgtcaacaatgctggttttactactagaccacctccaccattggaaattttgttgcaaccatcttctccatacggtagaccatacttcaaagctaagtctgatttcgtcaaagaacccattccagttttgggtttaaagggtatgttcaagagaatgatcgaagaggatgcctctttcttgatttggaaaccatacggtggtatgatggctagaattccagaatccgaaattccatttccacacagaaacggtactatcttcaagatccattacttcaccaagtggtctgaaaacggttcttcttctgatgacaaacacatgaagtggatcagggaactgtattcttatatgaccccatacgtttcttctaacccaagacaagcttacgttaactacagagatttggacatcggtcagaacaagaagaatgactctgaagataactttagaagggctcaaatttggggtgctaagtactttaagaacaacttcaacaggctggtcaagatcaagacaaaagttgatccagaaaacttgttcaggcacgaacaatctattccaccattaccaattagaaggcagacctct

SEQ ID NO: 109 - protein, 523 aa, Artificial Sequence
  Synthetic Construct
MKEPTSSTSLQDDFIKCLHRNTNVDFPLDKTFFTPQRNSSNFKEVLNTTVWNQRYMTKSMPKPEFIFKPVHESHVQASIICSKKLRIHFRVRSGGHDYEGLSYVSQMETPFVLIDLWKLKQINVDIEDNSAWVQAGATTGELYYRIAAKSKVHGFPAGLCSTVGIGGHITGGGYGTLMRKYGLSTDNVLDARIVDANGQLLNRTAMGEDLFWAIRGGGGGSFGVILAWKIKLVPVPETLTIFTITKTLEQDAGFKILSKWQRIVDKLVEELSIRVLFRNTGNKTVTTTYRGEFLGEKGTLMEVMKKCFPELGLTQEDCIEMSWIETVVNNAGFTTRPPPPLEILLQPSSPYGRPYFKAKSDFVKEPIPVLGLKGMFKRMIEEDASFLIWKPYGGMMARIPESEIPFPHRNGTIFKIHYFTKWSENGSSSDDKHMKWIRELYSYMTPYVSSNPRQAYVNYRDLDIGQNKKNDSEDNFRRAQIWGAKYFKNNFNRLVKIKTKVDPENLFRHEQSIPPLPIRRQTS

SEQ ID NO: 110 - DNA, 1593 bp, Artificial Sequence
  CBS134-A0A1J3CT99-no signal peptide-strep Tag
  CDS (1)..(1593)
atgaaagaacctacctcttctacctcattgcaagatgatttcatcaagtgcttgcacagaaacaccaatgttgatttcccattggacaagactttcttcactccacaaagaaactcctccaacttcaaagaagttttgaacaccaccgtctggaatcaaagatatatgactaagtctatgcccaagccagagttcatttttaagccagttcatgaatcccatgtccaagcctctattatttgctctaagaagttgagaatccacttcagagttagatctggtggtcatgattatgagggtttgtcttacgtttctcaaatggaaactccattcgtcttgatcgatttgtggaagttgaagcaaatcaacgtcgacatcgaagataattctgcttgggttcaagctggtgctactactggtgagttgtattatagaattgctgccaagtctaaggttcatggttttccagctggtttgtgttctactgttggtataggtggtcatatcactggtggtggttatggtactttgatgagaaagtatggtttgtccaccgataacgttttggatgctagaatcgttgatgctaatggtcagttgttgaacagaactgctatgggtgaagatttgttctgggctattagaggtggtggtggcggttcatttggtgttattttggcttggaagatcaagttggttccagttccagaaactttgaccattttcactattaccaagaccttggaacaagatgccggtttcaagattttgtctaagtggcaaagaatcgtcgacaagttggtagaagaattgtccatcagagtcttgttcagaaacactggtaacaagactgttactactacctacagaggtgaattcttgggtgaaaaaggtacattgatggaagtcatgaagaagtgctttccagaattgggtttgactcaagaggattgcattgaaatgtcttggatcgaaactgttgtcaacaatgctggttttactactagaccacctccaccattggaaattttgttgcaaccatcttctccatacggtagaccatacttcaaagctaagtctgatttcgtcaaagaacccattccagttttgggtttaaagggtatgttcaagagaatgatcgaagaggatgcctctttcttgatttggaaaccatacggtggtatgatggctagaattccagaatccgaaattccatttccacacagaaacggtactatcttcaagatccattacttcaccaagtggtctgaaaacggttcttcttctgatgacaaacacatgaagtggatcagggaactgtattcttatatgaccccatacgtttcttctaacccaagacaagcttacgttaactacagagatttggacatcggtcagaacaagaagaatgactctgaagataactttagaagggctcaaatttggggtgctaagtactttaagaacaacttcaacaggctggtcaagatcaagacaaaagttgatccagaaaacttgttcaggcacgaacaatctattccaccattaccaattagaaggcagacctcttggtcacatccacaatttgaaaag

SEQ ID NO: 111 - protein, 531 aa, Artificial Sequence
  Synthetic Construct
MKEPTSSTSLQDDFIKCLHRNTNVDFPLDKTFFTPQRNSSNFKEVLNTTVWNQRYMTKSMPKPEFIFKPVHESHVQASIICSKKLRIHFRVRSGGHDYEGLSYVSQMETPFVLIDLWKLKQINVDIEDNSAWVQAGATTGELYYRIAAKSKVHGFPAGLCSTVGIGGHITGGGYGTLMRKYGLSTDNVLDARIVDANGQLLNRTAMGEDLFWAIRGGGGGSFGVILAWKIKLVPVPETLTIFTITKTLEQDAGFKILSKWQRIVDKLVEELSIRVLFRNTGNKTVTTTYRGEFLGEKGTLMEVMKKCFPELGLTQEDCIEMSWIETVVNNAGFTTRPPPPLEILLQPSSPYGRPYFKAKSDFVKEPIPVLGLKGMFKRMIEEDASFLIWKPYGGMMARIPESEIPFPHRNGTIFKIHYFTKWSENGSSSDDKHMKWIRELYSYMTPYVSSNPRQAYVNYRDLDIGQNKKNDSEDNFRRAQIWGAKYFKNNFNRLVKIKTKVDPENLFRHEQSIPPLPIRRQTSWSHPQFEK

SEQ ID NO: 112 - DNA, 1650 bp, Artificial Sequence
  CBS134-A0A1J3CT99- truncated alpha factor - no signal peptide-strep Tag
  CDS (1)..(1650)
atgagatttccttccatcttcacggctgtgctatttgcagcatcctccgcacttgcaatgaaagaacctacctcttctacctcattgcaagatgatttcatcaagtgcttgcacagaaacaccaatgttgatttcccattggacaagactttcttcactccacaaagaaactcctccaacttcaaagaagttttgaacaccaccgtctggaatcaaagatatatgactaagtctatgcccaagccagagttcatttttaagccagttcatgaatcccatgtccaagcctctattatttgctctaagaagttgagaatccacttcagagttagatctggtggtcatgattatgagggtttgtcttacgtttctcaaatggaaactccattcgtcttgatcgatttgtggaagttgaagcaaatcaacgtcgacatcgaagataattctgcttgggttcaagctggtgctactactggtgagttgtattatagaattgctgccaagtctaaggttcatggttttccagctggtttgtgttctactgttggtataggtggtcatatcactggtggtggttatggtactttgatgagaaagtatggtttgtccaccgataacgttttggatgctagaatcgttgatgctaatggtcagttgttgaacagaactgctatgggtgaagatttgttctgggctattagaggtggtggtggcggttcatttggtgttattttggcttggaagatcaagttggttccagttccagaaactttgaccattttcactattaccaagaccttggaacaagatgccggtttcaagattttgtctaagtggcaaagaatcgtcgacaagttggtagaagaattgtccatcagagtcttgttcagaaacactggtaacaagactgttactactacctacagaggtgaattcttgggtgaaaaaggtacattgatggaagtcatgaagaagtgctttccagaattgggtttgactcaagaggattgcattgaaatgtcttggatcgaaactgttgtcaacaatgctggttttactactagaccacctccaccattggaaattttgttgcaaccatcttctccatacggtagaccatacttcaaagctaagtctgatttcgtcaaagaacccattccagttttgggtttaaagggtatgttcaagagaatgatcgaagaggatgcctctttcttgatttggaaaccatacggtggtatgatggctagaattccagaatccgaaattccatttccacacagaaacggtactatcttcaagatccattacttcaccaagtggtctgaaaacggttcttcttctgatgacaaacacatgaagtggatcagggaactgtattcttatatgaccccatacgtttcttctaacccaagacaagcttacgttaactacagagatttggacatcggtcagaacaagaagaatgactctgaagataactttagaagggctcaaatttggggtgctaagtactttaagaacaacttcaacaggctggtcaagatcaagacaaaagttgatccagaaaacttgttcaggcacgaacaatctattccaccattaccaattagaaggcagacctcttggtcacatccacaatttgaaaag

SEQ ID NO: 113 - protein, 550 aa, Artificial Sequence
  Synthetic Construct
MRFPSIFTAVLFAASSALAMKEPTSSTSLQDDFIKCLHRNTNVDFPLDKTFFTPQRNSSNFKEVLNTTVWNQRYMTKSMPKPEFIFKPVHESHVQASIICSKKLRIHFRVRSGGHDYEGLSYVSQMETPFVLIDLWKLKQINVDIEDNSAWVQAGATTGELYYRIAAKSKVHGFPAGLCSTVGIGGHITGGGYGTLMRKYGLSTDNVLDARIVDANGQLLNRTAMGEDLFWAIRGGGGGSFGVILAWKIKLVPVPETLTIFTITKTLEQDAGFKILSKWQRIVDKLVEELSIRVLFRNTGNKTVTTTYRGEFLGEKGTLMEVMKKCFPELGLTQEDCIEMSWIETVVNNAGFTTRPPPPLEILLQPSSPYGRPYFKAKSDFVKEPIPVLGLKGMFKRMIEEDASFLIWKPYGGMMARIPESEIPFPHRNGTIFKIHYFTKWSENGSSSDDKHMKWIRELYSYMTPYVSSNPRQAYVNYRDLDIGQNKKNDSEDNFRRAQIWGAKYFKNNFNRLVKIKTKVDPENLFRHEQSIPPLPIRRQTSWSHPQFEK

SEQ ID NO: 114 - DNA, 1860 bp, Artificial Sequence
  CBS134-A0A1J3CT99-full alpha factor-no signal peptide-strep Tag
  CDS (1)..(1860)
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagctatgaaagaacctacctcttctacctcattgcaagatgatttcatcaagtgcttgcacagaaacaccaatgttgatttcccattggacaagactttcttcactccacaaagaaactcctccaacttcaaagaagttttgaacaccaccgtctggaatcaaagatatatgactaagtctatgcccaagccagagttcatttttaagccagttcatgaatcccatgtccaagcctctattatttgctctaagaagttgagaatccacttcagagttagatctggtggtcatgattatgagggtttgtcttacgtttctcaaatggaaactccattcgtcttgatcgatttgtggaagttgaagcaaatcaacgtcgacatcgaagataattctgcttgggttcaagctggtgctactactggtgagttgtattatagaattgctgccaagtctaaggttcatggttttccagctggtttgtgttctactgttggtataggtggtcatatcactggtggtggttatggtactttgatgagaaagtatggtttgtccaccgataacgttttggatgctagaatcgttgatgctaatggtcagttgttgaacagaactgctatgggtgaagatttgttctgggctattagaggtggtggtggcggttcatttggtgttattttggcttggaagatcaagttggttccagttccagaaactttgaccattttcactattaccaagaccttggaacaagatgccggtttcaagattttgtctaagtggcaaagaatcgtcgacaagttggtagaagaattgtccatcagagtcttgttcagaaacactggtaacaagactgttactactacctacagaggtgaattcttgggtgaaaaaggtacattgatggaagtcatgaagaagtgctttccagaattgggtttgactcaagaggattgcattgaaatgtcttggatcgaaactgttgtcaacaatgctggttttactactagaccacctccaccattggaaattttgttgcaaccatcttctccatacggtagaccatacttcaaagctaagtctgatttcgtcaaagaacccattccagttttgggtttaaagggtatgttcaagagaatgatcgaagaggatgcctctttcttgatttggaaaccatacggtggtatgatggctagaattccagaatccgaaattccatttccacacagaaacggtactatcttcaagatccattacttcaccaagtggtctgaaaacggttcttcttctgatgacaaacacatgaagtggatcagggaactgtattcttatatgaccccatacgtttcttctaacccaagacaagcttacgttaactacagagatttggacatcggtcagaacaagaagaatgactctgaagataactttagaagggctcaaatttggggtgctaagtactttaagaacaacttcaacaggctggtcaagatcaagacaaaagttgatccagaaaacttgttcaggcacgaacaatctattccaccattaccaattagaaggcagacctcttggtcacatccacaatttgaaaag

SEQ ID NO: 115 - protein, 620 aa, Artificial Sequence
  Synthetic Construct
MRFPSIFTAVLFAASSALAAPVNTTTEDETAQIPAEAVIGYSDLEGDFDVAVLPFSNSTNNGLLFINTTIASIAAKEEGVSLEKREAEAMKEPTSSTSLQDDFIKCLHRNTNVDFPLDKTFFTPQRNSSNFKEVLNTTVWNQRYMTKSMPKPEFIFKPVHESHVQASIICSKKLRIHFRVRSGGHDYEGLSYVSQMETPFVLIDLWKLKQINVDIEDNSAWVQAGATTGELYYRIAAKSKVHGFPAGLCSTVGIGGHITGGGYGTLMRKYGLSTDNVLDARIVDANGQLLNRTAMGEDLFWAIRGGGGGSFGVILAWKIKLVPVPETLTIFTITKTLEQDAGFKILSKWQRIVDKLVEELSIRVLFRNTGNKTVTTTYRGEFLGEKGTLMEVMKKCFPELGLTQEDCIEMSWIETVVNNAGFTTRPPPPLEILLQPSSPYGRPYFKAKSDFVKEPIPVLGLKGMFKRMIEEDASFLIWKPYGGMMARIPESEIPFPHRNGTIFKIHYFTKWSENGSSSDDKHMKWIRELYSYMTPYVSSNPRQAYVNYRDLDIGQNKKNDSEDNFRRAQIWGAKYFKNNFNRLVKIKTKVDPENLFRHEQSIPPLPIRRQTSWSHPQFEK

SEQ ID NO: 116 - DNA, 1638 bp, Artificial Sequence
  CBS146-A0A1J3J6A2
  CDS (1)..(1638)
atgaggatctctaagccaattccagtcatctcctacattttgttcttggcccaatacttctcattgcacacaaaagaacctacctcttctacctcattgcaagatgattttgttaagtgcttgcacagaaacaccaacgttgattttccattggacaagactttcttcaccccacaaagaaactcctccaacttcaaagaagtcttgaactctaccgtctggaatcaaagatatatgaccaagtctatgccaaagccagagttcatttttaagccagttcatgaatcccatgtccaagcctctattatttgctctaagaagttgagaatccacttcagagttagatctggtggtcatgattatgagggtttgtcttacgtttctcaaatggaaactccattcgtcttgatcgatttgtggaagttgaagcagattaacgtcgacatcgaagataattctgcttgggttcaagctggtgctactactggtgagttgtattatagaattgccgagaagtctaaggttcatggttttccagctggtttgtgttctactgttggtataggtggtcatatcactggtggtggttatggtactttgatgagaaagtatggtttgtccaccgataacgttttggatgctagaatcgttgatgctaatggtcagttgttgaacagaactgctatgggtgaagatttgttctgggctatttctggtggcggtggtggtagttttggtgttattttggcttggaagattaagttggttccagttccagaaaccttgaccattttcactattaccaagaccttggaacaagatgccggtttcaagattttgtccaaatggcaaagaatcgtcgacaagttggttgaagaattgtccatcagagtcttgttcagaaacactggtaacaagactgttactactacctacagaggtgaattcttgggtgaaaaaggtacattgatggaagtcatgaacaagtgctttccagaattgggtttgactcaagaggattgcattgaaatgtcttggatcgaaactgttgtcaacaatgctggttttactactagaccaccacctccattggaaattttgttgcaaccatcttctccatacggtagaccatacttcaaagctaagtctgatttcgtcaaagaacccattccagttttgggtttaaagggtatgttcaagagaatgatcgaagaggatgcctctttcttgatttggaaaccatacggtggtatgatggctagaattccagaatctgaattgccatttccacacagaaacggtactattttcaagatccattacttcaccaagtggtccgaaaatggttcttcttctgatgacaaacacatgaagtggatcagggaactgtattcttatatgaccccatacgtttcttctaacccaagacaagcttacgttaactacagagatttggacatcggtcagaacaagaagaacgattctgaaaacaatttcagaagggctcaaatttggggtgctaagtactttaagaacaacttcaacaggctggtcaagatcaagacaaaagttgatccagaaaacttgttcaggcacgaacaatctattccaccattgccaattagaaggcaaacctct

SEQ ID NO: 117 - protein, 546 aa, Artificial Sequence
  Synthetic Construct
MRISKPIPVISYILFLAQYFSLHTKEPTSSTSLQDDFVKCLHRNTNVDFPLDKTFFTPQRNSSNFKEVLNSTVWNQRYMTKSMPKPEFIFKPVHESHVQASIICSKKLRIHFRVRSGGHDYEGLSYVSQMETPFVLIDLWKLKQINVDIEDNSAWVQAGATTGELYYRIAEKSKVHGFPAGLCSTVGIGGHITGGGYGTLMRKYGLSTDNVLDARIVDANGQLLNRTAMGEDLFWAISGGGGGSFGVILAWKIKLVPVPETLTIFTITKTLEQDAGFKILSKWQRIVDKLVEELSIRVLFRNTGNKTVTTTYRGEFLGEKGTLMEVMNKCFPELGLTQEDCIEMSWIETVVNNAGFTTRPPPPLEILLQPSSPYGRPYFKAKSDFVKEPIPVLGLKGMFKRMIEEDASFLIWKPYGGMMARIPESELPFPHRNGTIFKIHYFTKWSENGSSSDDKHMKWIRELYSYMTPYVSSNPRQAYVNYRDLDIGQNKKNDSENNFRRAQIWGAKYFKNNFNRLVKIKTKVDPENLFRHEQSIPPLPIRRQTS

SEQ ID NO: 118 - DNA, 1569 bp, Artificial Sequence
  CBS146-A0A1J3J6A2-no signal peptide
  CDS (1)..(1569)
atgaaagaacctacctcttctacctcattgcaagatgattttgttaagtgcttgcacagaaacaccaacgttgattttccattggacaagactttcttcaccccacaaagaaactcctccaacttcaaagaagtcttgaactctaccgtctggaatcaaagatatatgaccaagtctatgccaaagccagagttcatttttaagccagttcatgaatcccatgtccaagcctctattatttgctctaagaagttgagaatccacttcagagttagatctggtggtcatgattatgagggtttgtcttacgtttctcaaatggaaactccattcgtcttgatcgatttgtggaagttgaagcagattaacgtcgacatcgaagataattctgcttgggttcaagctggtgctactactggtgagttgtattatagaattgccgagaagtctaaggttcatggttttccagctggtttgtgttctactgttggtataggtggtcatatcactggtggtggttatggtactttgatgagaaagtatggtttgtccaccgataacgttttggatgctagaatcgttgatgctaatggtcagttgttgaacagaactgctatgggtgaagatttgttctgggctatttctggtggcggtggtggtagttttggtgttattttggcttggaagattaagttggttccagttccagaaaccttgaccattttcactattaccaagaccttggaacaagatgccggtttcaagattttgtccaaatggcaaagaatcgtcgacaagttggttgaagaattgtccatcagagtcttgttcagaaacactggtaacaagactgttactactacctacagaggtgaattcttgggtgaaaaaggtacattgatggaagtcatgaacaagtgctttccagaattgggtttgactcaagaggattgcattgaaatgtcttggatcgaaactgttgtcaacaatgctggttttactactagaccaccacctccattggaaattttgttgcaaccatcttctccatacggtagaccatacttcaaagctaagtctgatttcgtcaaagaacccattccagttttgggtttaaagggtatgttcaagagaatgatcgaagaggatgcctctttcttgatttggaaaccatacggtggtatgatggctagaattccagaatctgaattgccatttccacacagaaacggtactattttcaagatccattacttcaccaagtggtccgaaaatggttcttcttctgatgacaaacacatgaagtggatcagggaactgtattcttatatgaccccatacgtttcttctaacccaagacaagcttacgttaactacagagatttggacatcggtcagaacaagaagaacgattctgaaaacaatttcagaagggctcaaatttggggtgctaagtactttaagaacaacttcaacaggctggtcaagatcaagacaaaagttgatccagaaaacttgttcaggcacgaacaatctattccaccattgccaattagaaggcaaacctct

SEQ ID NO: 119 - protein, 523 aa, Artificial Sequence
  Synthetic Construct
MKEPTSSTSLQDDFVKCLHRNTNVDFPLDKTFFTPQRNSSNFKEVLNSTVWNQRYMTKSMPKPEFIFKPVHESHVQASIICSKKLRIHFRVRSGGHDYEGLSYVSQMETPFVLIDLWKLKQINVDIEDNSAWVQAGATTGELYYRIAEKSKVHGFPAGLCSTVGIGGHITGGGYGTLMRKYGLSTDNVLDARIVDANGQLLNRTAMGEDLFWAISGGGGGSFGVILAWKIKLVPVPETLTIFTITKTLEQDAGFKILSKWQRIVDKLVEELSIRVLFRNTGNKTVTTTYRGEFLGEKGTLMEVMNKCFPELGLTQEDCIEMSWIETVVNNAGFTTRPPPPLEILLQPSSPYGRPYFKAKSDFVKEPIPVLGLKGMFKRMIEEDASFLIWKPYGGMMARIPESELPFPHRNGTIFKIHYFTKWSENGSSSDDKHMKWIRELYSYMTPYVSSNPRQAYVNYRDLDIGQNKKNDSENNFRRAQIWGAKYFKNNFNRLVKIKTKVDPENLFRHEQSIPPLPIRRQTS

SEQ ID NO: 120 - DNA, 1593 bp, Artificial Sequence
  CBS146-A0A1J3J6A2- no signal peptide-strep Tag
  CDS (1)..(1593)
atgaaagaacctacctcttctacctcattgcaagatgattttgttaagtgcttgcacagaaacaccaacgttgattttccattggacaagactttcttcaccccacaaagaaactcctccaacttcaaagaagtcttgaactctaccgtctggaatcaaagatatatgaccaagtctatgccaaagccagagttcatttttaagccagttcatgaatcccatgtccaagcctctattatttgctctaagaagttgagaatccacttcagagttagatctggtggtcatgattatgagggtttgtcttacgtttctcaaatggaaactccattcgtcttgatcgatttgtggaagttgaagcagattaacgtcgacatcgaagataattctgcttgggttcaagctggtgctactactggtgagttgtattatagaattgccgagaagtctaaggttcatggttttccagctggtttgtgttctactgttggtataggtggtcatatcactggtggtggttatggtactttgatgagaaagtatggtttgtccaccgataacgttttggatgctagaatcgttgatgctaatggtcagttgttgaacagaactgctatgggtgaagatttgttctgggctatttctggtggcggtggtggtagttttggtgttattttggcttggaagattaagttggttccagttccagaaaccttgaccattttcactattaccaagaccttggaacaagatgccggtttcaagattttgtccaaatggcaaagaatcgtcgacaagttggttgaagaattgtccatcagagtcttgttcagaaacactggtaacaagactgttactactacctacagaggtgaattcttgggtgaaaaaggtacattgatggaagtcatgaacaagtgctttccagaattgggtttgactcaagaggattgcattgaaatgtcttggatcgaaactgttgtcaacaatgctggttttactactagaccaccacctccattggaaattttgttgcaaccatcttctccatacggtagaccatacttcaaagctaagtctgatttcgtcaaagaacccattccagttttgggtttaaagggtatgttcaagagaatgatcgaagaggatgcctctttcttgatttggaaaccatacggtggtatgatggctagaattccagaatctgaattgccatttccacacagaaacggtactattttcaagatccattacttcaccaagtggtccgaaaatggttcttcttctgatgacaaacacatgaagtggatcagggaactgtattcttatatgaccccatacgtttcttctaacccaagacaagcttacgttaactacagagatttggacatcggtcagaacaagaagaacgattctgaaaacaatttcagaagggctcaaatttggggtgctaagtactttaagaacaacttcaacaggctggtcaagatcaagacaaaagttgatccagaaaacttgttcaggcacgaacaatctattccaccattgccaattagaaggcaaacctcttggtcacatccacaatttgaaaag

SEQ ID NO: 121 - protein, 531 aa, Artificial Sequence
  Synthetic Construct
MKEPTSSTSLQDDFVKCLHRNTNVDFPLDKTFFTPQRNSSNFKEVLNSTVWNQRYMTKSMPKPEFIFKPVHESHVQASIICSKKLRIHFRVRSGGHDYEGLSYVSQMETPFVLIDLWKLKQINVDIEDNSAWVQAGATTGELYYRIAEKSKVHGFPAGLCSTVGIGGHITGGGYGTLMRKYGLSTDNVLDARIVDANGQLLNRTAMGEDLFWAISGGGGGSFGVILAWKIKLVPVPETLTIFTITKTLEQDAGFKILSKWQRIVDKLVEELSIRVLFRNTGNKTVTTTYRGEFLGEKGTLMEVMNKCFPELGLTQEDCIEMSWIETVVNNAGFTTRPPPPLEILLQPSSPYGRPYFKAKSDFVKEPIPVLGLKGMFKRMIEEDASFLIWKPYGGMMARIPESELPFPHRNGTIFKIHYFTKWSENGSSSDDKHMKWIRELYSYMTPYVSSNPRQAYVNYRDLDIGQNKKNDSENNFRRAQIWGAKYFKNNFNRLVKIKTKVDPENLFRHEQSIPPLPIRRQTSWSHPQFEK

SEQ ID NO: 122 - DNA, 1650 bp, Artificial Sequence
  CBS146-A0A1J3J6A2-truncated alpha factor - no signal peptide-strep Tag
  CDS (1)..(1650)
atgagatttccttccatcttcacggctgtgctatttgcagcatcctccgcacttgcaatgaaagaacctacctcttctacctcattgcaagatgattttgttaagtgcttgcacagaaacaccaacgttgattttccattggacaagactttcttcaccccacaaagaaactcctccaacttcaaagaagtcttgaactctaccgtctggaatcaaagatatatgaccaagtctatgccaaagccagagttcatttttaagccagttcatgaatcccatgtccaagcctctattatttgctctaagaagttgagaatccacttcagagttagatctggtggtcatgattatgagggtttgtcttacgtttctcaaatggaaactccattcgtcttgatcgatttgtggaagttgaagcagattaacgtcgacatcgaagataattctgcttgggttcaagctggtgctactactggtgagttgtattatagaattgccgagaagtctaaggttcatggttttccagctggtttgtgttctactgttggtataggtggtcatatcactggtggtggttatggtactttgatgagaaagtatggtttgtccaccgataacgttttggatgctagaatcgttgatgctaatggtcagttgttgaacagaactgctatgggtgaagatttgttctgggctatttctggtggcggtggtggtagttttggtgttattttggcttggaagattaagttggttccagttccagaaaccttgaccattttcactattaccaagaccttggaacaagatgccggtttcaagattttgtccaaatggcaaagaatcgtcgacaagttggttgaagaattgtccatcagagtcttgttcagaaacactggtaacaagactgttactactacctacagaggtgaattcttgggtgaaaaaggtacattgatggaagtcatgaacaagtgctttccagaattgggtttgactcaagaggattgcattgaaatgtcttggatcgaaactgttgtcaacaatgctggttttactactagaccaccacctccattggaaattttgttgcaaccatcttctccatacggtagaccatacttcaaagctaagtctgatttcgtcaaagaacccattccagttttgggtttaaagggtatgttcaagagaatgatcgaagaggatgcctctttcttgatttggaaaccatacggtggtatgatggctagaattccagaatctgaattgccatttccacacagaaacggtactattttcaagatccattacttcaccaagtggtccgaaaatggttcttcttctgatgacaaacacatgaagtggatcagggaactgtattcttatatgaccccatacgtttcttctaacccaagacaagcttacgttaactacagagatttggacatcggtcagaacaagaagaacgattctgaaaacaatttcagaagggctcaaatttggggtgctaagtactttaagaacaacttcaacaggctggtcaagatcaagacaaaagttgatccagaaaacttgttcaggcacgaacaatctattccaccattgccaattagaaggcaaacctcttggtcacatccacaatttgaaaag

SEQ ID NO: 123 - protein, 550 aa, Artificial Sequence
  Synthetic Construct
MRFPSIFTAVLFAASSALAMKEPTSSTSLQDDFVKCLHRNTNVDFPLDKTFFTPQRNSSNFKEVLNSTVWNQRYMTKSMPKPEFIFKPVHESHVQASIICSKKLRIHFRVRSGGHDYEGLSYVSQMETPFVLIDLWKLKQINVDIEDNSAWVQAGATTGELYYRIAEKSKVHGFPAGLCSTVGIGGHITGGGYGTLMRKYGLSTDNVLDARIVDANGQLLNRTAMGEDLFWAISGGGGGSFGVILAWKIKLVPVPETLTIFTITKTLEQDAGFKILSKWQRIVDKLVEELSIRVLFRNTGNKTVTTTYRGEFLGEKGTLMEVMNKCFPELGLTQEDCIEMSWIETVVNNAGFTTRPPPPLEILLQPSSPYGRPYFKAKSDFVKEPIPVLGLKGMFKRMIEEDASFLIWKPYGGMMARIPESELPFPHRNGTIFKIHYFTKWSENGSSSDDKHMKWIRELYSYMTPYVSSNPRQAYVNYRDLDIGQNKKNDSENNFRRAQIWGAKYFKNNFNRLVKIKTKVDPENLFRHEQSIPPLPIRRQTSWSHPQFEK

SEQ ID NO: 124 - DNA, 1860 bp, Artificial Sequence
  CBS146-A0A1J3J6A2- full alpha factor -no signal peptide-strep Tag
  CDS (1)..(1860)
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagctatgaaagaacctacctcttctacctcattgcaagatgattttgttaagtgcttgcacagaaacaccaacgttgattttccattggacaagactttcttcaccccacaaagaaactcctccaacttcaaagaagtcttgaactctaccgtctggaatcaaagatatatgaccaagtctatgccaaagccagagttcatttttaagccagttcatgaatcccatgtccaagcctctattatttgctctaagaagttgagaatccacttcagagttagatctggtggtcatgattatgagggtttgtcttacgtttctcaaatggaaactccattcgtcttgatcgatttgtggaagttgaagcagattaacgtcgacatcgaagataattctgcttgggttcaagctggtgctactactggtgagttgtattatagaattgccgagaagtctaaggttcatggttttccagctggtttgtgttctactgttggtataggtggtcatatcactggtggtggttatggtactttgatgagaaagtatggtttgtccaccgataacgttttggatgctagaatcgttgatgctaatggtcagttgttgaacagaactgctatgggtgaagatttgttctgggctatttctggtggcggtggtggtagttttggtgttattttggcttggaagattaagttggttccagttccagaaaccttgaccattttcactattaccaagaccttggaacaagatgccggtttcaagattttgtccaaatggcaaagaatcgtcgacaagttggttgaagaattgtccatcagagtcttgttcagaaacactggtaacaagactgttactactacctacagaggtgaattcttgggtgaaaaaggtacattgatggaagtcatgaacaagtgctttccagaattgggtttgactcaagaggattgcattgaaatgtcttggatcgaaactgttgtcaacaatgctggttttactactagaccaccacctccattggaaattttgttgcaaccatcttctccatacggtagaccatacttcaaagctaagtctgatttcgtcaaagaacccattccagttttgggtttaaagggtatgttcaagagaatgatcgaagaggatgcctctttcttgatttggaaaccatacggtggtatgatggctagaattccagaatctgaattgccatttccacacagaaacggtactattttcaagatccattacttcaccaagtggtccgaaaatggttcttcttctgatgacaaacacatgaagtggatcagggaactgtattcttatatgaccccatacgtttcttctaacccaagacaagcttacgttaactacagagatttggacatcggtcagaacaagaagaacgattctgaaaacaatttcagaagggctcaaatttggggtgctaagtactttaagaacaacttcaacaggctggtcaagatcaagacaaaagttgatccagaaaacttgttcaggcacgaacaatctattccaccattgccaattagaaggcaaacctcttggtcacatccacaatttgaaaag

SEQ ID NO: 125 - protein, 620 aa, Artificial Sequence
  Synthetic Construct
MRFPSIFTAVLFAASSALAAPVNTTTEDETAQIPAEAVIGYSDLEGDFDVAVLPFSNSTNNGLLFINTTIASIAAKEEGVSLEKREAEAMKEPTSSTSLQDDFVKCLHRNTNVDFPLDKTFFTPQRNSSNFKEVLNSTVWNQRYMTKSMPKPEFIFKPVHESHVQASIICSKKLRIHFRVRSGGHDYEGLSYVSQMETPFVLIDLWKLKQINVDIEDNSAWVQAGATTGELYYRIAEKSKVHGFPAGLCSTVGIGGHITGGGYGTLMRKYGLSTDNVLDARIVDANGQLLNRTAMGEDLFWAISGGGGGSFGVILAWKIKLVPVPETLTIFTITKTLEQDAGFKILSKWQRIVDKLVEELSIRVLFRNTGNKTVTTTYRGEFLGEKGTLMEVMNKCFPELGLTQEDCIEMSWIETVVNNAGFTTRPPPPLEILLQPSSPYGRPYFKAKSDFVKEPIPVLGLKGMFKRMIEEDASFLIWKPYGGMMARIPESELPFPHRNGTIFKIHYFTKWSENGSSSDDKHMKWIRELYSYMTPYVSSNPRQAYVNYRDLDIGQNKKNDSENNFRRAQIWGAKYFKNNFNRLVKIKTKVDPENLFRHEQSIPPLPIRRQTSWSHPQFEK

SEQ ID NO: 126 - DNA, 1629 bp, Artificial Sequence
  CBS152-A0A1S3BE31
  CDS (1)..(1629)
atgaagtccttgatcacctctttcttgcacatcttcatcgttttgtcttttgcttgggctgcttctgctcataatcatgaatctttcttacactgcttgtcccatcattctccaaacacctcttctatctccaagattatctacactccaactaacccctcttactcctctgttttgaacttctccattcacaacttgagattcacctctccaaaaactccaaagccacatattatcgttaccccattcttggtgtctcaaattcaagcctctattatctgcgctaaaaagaccggtttccaaatcagaactagatctggtggtcatgattacgaaggtttgtcttacgtttccgatgtttccttcgttgttgttgacttgattaacctgagatccatttctgttgatgccgaaaacaatgttgcttgggttcaatctggtgctactattggtgagttgtactacagaattgccgaaaagtctaagaccttgggttttccagctggtgtttgtccaactgttggtgttggtggtcacttttctggtggtggttatggtttgatgttgagaaaatttggtttggccgctgataacgtcattgatgcttacttcattgatgtcaacggtaagctgcatgacagaaaatctatgggtgaagatgttttctgggctattagaggtggtggtggcgcttcttttggtatagttttggcttggaagatcaagttgttgccagttccatctatcgttactgttttcactattaccagaaccttggaacaaaacgccaccgatttgattcatagatggcaatacgtttcttctaagcaggatgacaagttgttcatcagaattatcttgaccggtatcaacaccaccaattcacaacatggtaacaagagaactattgaagctgccttcaactctttgttcttgggtaagattgaagagttggtcccaattatggaaaagactttcccagaattgggtttgaccaaagaagattgcattgagatgtcctggattgagtctgtcttgtactttgctggtttttctagaggtcaaccattgaacgttttgttggatagaaggccattgactccaaagagatttttcaaggctaagtccgattacgtcaacgaacctattccaaaagctggtttggaaggtatttgggagttgttcgatgaagaagaagctgaagctgctgttttgattttgtctccatacggtggtatcatggacaagatttccgaatccgaaattccatttccacatagagctggcaacctgtacaaaatccaacatttggtttactgggacgaagaaggtgaagatattgctaagagacatatcaactggatcagaaagctgtactcttacatggctccattcgtttctaaaaatccaagagctgcctacatcaactacagagatttggatattggcaccaacgaaaagaacggtagaaacacttcttacaacgaagcttctgtttggggtgttaagtactttaagggtaacttcaagaggctggtttctgttaagacaaaggttgacccatccaatttcttcaagaacgaacaatccattccatccttgaaaccatggtggaacaagagaggttat

SEQ ID NO: 127 - protein, 543 aa, Artificial Sequence
  Synthetic Construct
MKSLITSFLHIFIVLSFAWAASAHNHESFLHCLSHHSPNTSSISKIIYTPTNPSYSSVLNFSIHNLRFTSPKTPKPHIIVTPFLVSQIQASIICAKKTGFQIRTRSGGHDYEGLSYVSDVSFVVVDLINLRSISVDAENNVAWVQSGATIGELYYRIAEKSKTLGFPAGVCPTVGVGGHFSGGGYGLMLRKFGLAADNVIDAYFIDVNGKLHDRKSMGEDVFWAIRGGGGASFGIVLAWKIKLLPVPSIVTVFTITRTLEQNATDLIHRWQYVSSKQDDKLFIRIILTGINTTNSQHGNKRTIEAAFNSLFLGKIEELVPIMEKTFPELGLTKEDCIEMSWIESVLYFAGFSRGQPLNVLLDRRPLTPKRFFKAKSDYVNEPIPKAGLEGIWELFDEEEAEAAVLILSPYGGIMDKISESEIPFPHRAGNLYKIQHLVYWDEEGEDIAKRHINWIRKLYSYMAPFVSKNPRAAYINYRDLDIGTNEKNGRNTSYNEASVWGVKYFKGNFKRLVSVKTKVDPSNFFKNEQSIPSLKPWWNKRGY

SEQ ID NO: 128 - DNA, 1566 bp, Artificial Sequence
  CBS152-A0A1S3BE31- no signal peptide
  CDS (1)..(1566)
atggctcataatcatgaatctttcttacactgcttgtcccatcattctccaaacacctcttctatctccaagattatctacactccaactaacccctcttactcctctgttttgaacttctccattcacaacttgagattcacctctccaaaaactccaaagccacatattatcgttaccccattcttggtgtctcaaattcaagcctctattatctgcgctaaaaagaccggtttccaaatcagaactagatctggtggtcatgattacgaaggtttgtcttacgtttccgatgtttccttcgttgttgttgacttgattaacctgagatccatttctgttgatgccgaaaacaatgttgcttgggttcaatctggtgctactattggtgagttgtactacagaattgccgaaaagtctaagaccttgggttttccagctggtgtttgtccaactgttggtgttggtggtcacttttctggtggtggttatggtttgatgttgagaaaatttggtttggccgctgataacgtcattgatgcttacttcattgatgtcaacggtaagctgcatgacagaaaatctatgggtgaagatgttttctgggctattagaggtggtggtggcgcttcttttggtatagttttggcttggaagatcaagttgttgccagttccatctatcgttactgttttcactattaccagaaccttggaacaaaacgccaccgatttgattcatagatggcaatacgtttcttctaagcaggatgacaagttgttcatcagaattatcttgaccggtatcaacaccaccaattcacaacatggtaacaagagaactattgaagctgccttcaactctttgttcttgggtaagattgaagagttggtcccaattatggaaaagactttcccagaattgggtttgaccaaagaagattgcattgagatgtcctggattgagtctgtcttgtactttgctggtttttctagaggtcaaccattgaacgttttgttggatagaaggccattgactccaaagagatttttcaaggctaagtccgattacgtcaacgaacctattccaaaagctggtttggaaggtatttgggagttgttcgatgaagaagaagctgaagctgctgttttgattttgtctccatacggtggtatcatggacaagatttccgaatccgaaattccatttccacatagagctggcaacctgtacaaaatccaacatttggtttactgggacgaagaaggtgaagatattgctaagagacatatcaactggatcagaaagctgtactcttacatggctccattcgtttctaaaaatccaagagctgcctacatcaactacagagatttggatattggcaccaacgaaaagaacggtagaaacacttcttacaacgaagcttctgtttggggtgttaagtactttaagggtaacttcaagaggctggtttctgttaagacaaaggttgacccatccaatttcttcaagaacgaacaatccattccatccttgaaaccatggtggaacaagagaggttat

SEQ ID NO: 129 - protein, 522 aa, Artificial Sequence
  Synthetic Construct
MAHNHESFLHCLSHHSPNTSSISKIIYTPTNPSYSSVLNFSIHNLRFTSPKTPKPHIIVTPFLVSQIQASIICAKKTGFQIRTRSGGHDYEGLSYVSDVSFVVVDLINLRSISVDAENNVAWVQSGATIGELYYRIAEKSKTLGFPAGVCPTVGVGGHFSGGGYGLMLRKFGLAADNVIDAYFIDVNGKLHDRKSMGEDVFWAIRGGGGASFGIVLAWKIKLLPVPSIVTVFTITRTLEQNATDLIHRWQYVSSKQDDKLFIRIILTGINTTNSQHGNKRTIEAAFNSLFLGKIEELVPIMEKTFPELGLTKEDCIEMSWIESVLYFAGFSRGQPLNVLLDRRPLTPKRFFKAKSDYVNEPIPKAGLEGIWELFDEEEAEAAVLILSPYGGIMDKISESEIPFPHRAGNLYKIQHLVYWDEEGEDIAKRHINWIRKLYSYMAPFVSKNPRAAYINYRDLDIGTNEKNGRNTSYNEASVWGVKYFKGNFKRLVSVKTKVDPSNFFKNEQSIPSLKPWWNKRGY

SEQ ID NO: 130 - DNA, 1590 bp, Artificial Sequence
  CBS152-A0A1S3BE31- no signal peptide-strep Tag
  CDS (1)..(1590)
atggctcataatcatgaatctttcttacactgcttgtcccatcattctccaaacacctcttctatctccaagattatctacactccaactaacccctcttactcctctgttttgaacttctccattcacaacttgagattcacctctccaaaaactccaaagccacatattatcgttaccccattcttggtgtctcaaattcaagcctctattatctgcgctaaaaagaccggtttccaaatcagaactagatctggtggtcatgattacgaaggtttgtcttacgtttccgatgtttccttcgttgttgttgacttgattaacctgagatccatttctgttgatgccgaaaacaatgttgcttgggttcaatctggtgctactattggtgagttgtactacagaattgccgaaaagtctaagaccttgggttttccagctggtgtttgtccaactgttggtgttggtggtcacttttctggtggtggttatggtttgatgttgagaaaatttggtttggccgctgataacgtcattgatgcttacttcattgatgtcaacggtaagctgcatgacagaaaatctatgggtgaagatgttttctgggctattagaggtggtggtggcgcttcttttggtatagttttggcttggaagatcaagttgttgccagttccatctatcgttactgttttcactattaccagaaccttggaacaaaacgccaccgatttgattcatagatggcaatacgtttcttctaagcaggatgacaagttgttcatcagaattatcttgaccggtatcaacaccaccaattcacaacatggtaacaagagaactattgaagctgccttcaactctttgttcttgggtaagattgaagagttggtcccaattatggaaaagactttcccagaattgggtttgaccaaagaagattgcattgagatgtcctggattgagtctgtcttgtactttgctggtttttctagaggtcaaccattgaacgttttgttggatagaaggccattgactccaaagagatttttcaaggctaagtccgattacgtcaacgaacctattccaaaagctggtttggaaggtatttgggagttgttcgatgaagaagaagctgaagctgctgttttgattttgtctccatacggtggtatcatggacaagatttccgaatccgaaattccatttccacatagagctggcaacctgtacaaaatccaacatttggtttactgggacgaagaaggtgaagatattgctaagagacatatcaactggatcagaaagctgtactcttacatggctccattcgtttctaaaaatccaagagctgcctacatcaactacagagatttggatattggcaccaacgaaaagaacggtagaaacacttcttacaacgaagcttctgtttggggtgttaagtactttaagggtaacttcaagaggctggtttctgttaagacaaaggttgacccatccaatttcttcaagaacgaacaatccattccatccttgaaaccatggtggaacaagagaggttattggtcacatccacaatttgaaaag

SEQ ID NO: 131 - protein, 530 aa, Artificial Sequence
  Synthetic Construct
MAHNHESFLHCLSHHSPNTSSISKIIYTPTNPSYSSVLNFSIHNLRFTSPKTPKPHIIVTPFLVSQIQASIICAKKTGFQIRTRSGGHDYEGLSYVSDVSFVVVDLINLRSISVDAENNVAWVQSGATIGELYYRIAEKSKTLGFPAGVCPTVGVGGHFSGGGYGLMLRKFGLAADNVIDAYFIDVNGKLHDRKSMGEDVFWAIRGGGGASFGIVLAWKIKLLPVPSIVTVFTITRTLEQNATDLIHRWQYVSSKQDDKLFIRIILTGINTTNSQHGNKRTIEAAFNSLFLGKIEELVPIMEKTFPELGLTKEDCIEMSWIESVLYFAGFSRGQPLNVLLDRRPLTPKRFFKAKSDYVNEPIPKAGLEGIWELFDEEEAEAAVLILSPYGGIMDKISESEIPFPHRAGNLYKIQHLVYWDEEGEDIAKRHINWIRKLYSYMAPFVSKNPRAAYINYRDLDIGTNEKNGRNTSYNEASVWGVKYFKGNFKRLVSVKTKVDPSNFFKNEQSIPSLKPWWNKRGYWSHPQFEK

SEQ ID NO: 132 - DNA, 1647 bp, Artificial Sequence
  CBS152-A0A1S3BE31- no signal peptide-truncated alpha factor-strep Tag
  CDS (1)..(1647)
atgagatttccttccatcttcacggctgtgctatttgcagcatcctccgcacttgcaatggctcataatcatgaatctttcttacactgcttgtcccatcattctccaaacacctcttctatctccaagattatctacactccaactaacccctcttactcctctgttttgaacttctccattcacaacttgagattcacctctccaaaaactccaaagccacatattatcgttaccccattcttggtgtctcaaattcaagcctctattatctgcgctaaaaagaccggtttccaaatcagaactagatctggtggtcatgattacgaaggtttgtcttacgtttccgatgtttccttcgttgttgttgacttgattaacctgagatccatttctgttgatgccgaaaacaatgttgcttgggttcaatctggtgctactattggtgagttgtactacagaattgccgaaaagtctaagaccttgggttttccagctggtgtttgtccaactgttggtgttggtggtcacttttctggtggtggttatggtttgatgttgagaaaatttggtttggccgctgataacgtcattgatgcttacttcattgatgtcaacggtaagctgcatgacagaaaatctatgggtgaagatgttttctgggctattagaggtggtggtggcgcttcttttggtatagttttggcttggaagatcaagttgttgccagttccatctatcgttactgttttcactattaccagaaccttggaacaaaacgccaccgatttgattcatagatggcaatacgtttcttctaagcaggatgacaagttgttcatcagaattatcttgaccggtatcaacaccaccaattcacaacatggtaacaagagaactattgaagctgccttcaactctttgttcttgggtaagattgaagagttggtcccaattatggaaaagactttcccagaattgggtttgaccaaagaagattgcattgagatgtcctggattgagtctgtcttgtactttgctggtttttctagaggtcaaccattgaacgttttgttggatagaaggccattgactccaaagagatttttcaaggctaagtccgattacgtcaacgaacctattccaaaagctggtttggaaggtatttgggagttgttcgatgaagaagaagctgaagctgctgttttgattttgtctccatacggtggtatcatggacaagatttccgaatccgaaattccatttccacatagagctggcaacctgtacaaaatccaacatttggtttactgggacgaagaaggtgaagatattgctaagagacatatcaactggatcagaaagctgtactcttacatggctccattcgtttctaaaaatccaagagctgcctacatcaactacagagatttggatattggcaccaacgaaaagaacggtagaaacacttcttacaacgaagcttctgtttggggtgttaagtactttaagggtaacttcaagaggctggtttctgttaagacaaaggttgacccatccaatttcttcaagaacgaacaatccattccatccttgaaaccatggtggaacaagagaggttattggtcacatccacaatttgaaaag

SEQ ID NO: 133 - protein, 549 aa, Artificial Sequence
  Synthetic Construct
MRFPSIFTAVLFAASSALAMAHNHESFLHCLSHHSPNTSSISKIIYTPTNPSYSSVLNFSIHNLRFTSPKTPKPHIIVTPFLVSQIQASIICAKKTGFQIRTRSGGHDYEGLSYVSDVSFVVVDLINLRSISVDAENNVAWVQSGATIGELYYRIAEKSKTLGFPAGVCPTVGVGGHFSGGGYGLMLRKFGLAADNVIDAYFIDVNGKLHDRKSMGEDVFWAIRGGGGASFGIVLAWKIKLLPVPSIVTVFTITRTLEQNATDLIHRWQYVSSKQDDKLFIRIILTGINTTNSQHGNKRTIEAAFNSLFLGKIEELVPIMEKTFPELGLTKEDCIEMSWIESVLYFAGFSRGQPLNVLLDRRPLTPKRFFKAKSDYVNEPIPKAGLEGIWELFDEEEAEAAVLILSPYGGIMDKISESEIPFPHRAGNLYKIQHLVYWDEEGEDIAKRHINWIRKLYSYMAPFVSKNPRAAYINYRDLDIGTNEKNGRNTSYNEASVWGVKYFKGNFKRLVSVKTKVDPSNFFKNEQSIPSLKPWWNKRGYWSHPQFEK

SEQ ID NO: 134 - DNA, 1857 bp, Artificial Sequence
  CBS152-A0A1S3BE31- no signal peptide-full alpha factor -strep Tag
  CDS (1)..(1857)
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagctatggctcataatcatgaatctttcttacactgcttgtcccatcattctccaaacacctcttctatctccaagattatctacactccaactaacccctcttactcctctgttttgaacttctccattcacaacttgagattcacctctccaaaaactccaaagccacatattatcgttaccccattcttggtgtctcaaattcaagcctctattatctgcgctaaaaagaccggtttccaaatcagaactagatctggtggtcatgattacgaaggtttgtcttacgtttccgatgtttccttcgttgttgttgacttgattaacctgagatccatttctgttgatgccgaaaacaatgttgcttgggttcaatctggtgctactattggtgagttgtactacagaattgccgaaaagtctaagaccttgggttttccagctggtgtttgtccaactgttggtgttggtggtcacttttctggtggtggttatggtttgatgttgagaaaatttggtttggccgctgataacgtcattgatgcttacttcattgatgtcaacggtaagctgcatgacagaaaatctatgggtgaagatgttttctgggctattagaggtggtggtggcgcttcttttggtatagttttggcttggaagatcaagttgttgccagttccatctatcgttactgttttcactattaccagaaccttggaacaaaacgccaccgatttgattcatagatggcaatacgtttcttctaagcaggatgacaagttgttcatcagaattatcttgaccggtatcaacaccaccaattcacaacatggtaacaagagaactattgaagctgccttcaactctttgttcttgggtaagattgaagagttggtcccaattatggaaaagactttcccagaattgggtttgaccaaagaagattgcattgagatgtcctggattgagtctgtcttgtactttgctggtttttctagaggtcaaccattgaacgttttgttggatagaaggccattgactccaaagagatttttcaaggctaagtccgattacgtcaacgaacctattccaaaagctggtttggaaggtatttgggagttgttcgatgaagaagaagctgaagctgctgttttgattttgtctccatacggtggtatcatggacaagatttccgaatccgaaattccatttccacatagagctggcaacctgtacaaaatccaacatttggtttactgggacgaagaaggtgaagatattgctaagagacatatcaactggatcagaaagctgtactcttacatggctccattcgtttctaaaaatccaagagctgcctacatcaactacagagatttggatattggcaccaacgaaaagaacggtagaaacacttcttacaacgaagcttctgtttggggtgttaagtactttaagggtaacttcaagaggctggtttctgttaagacaaaggttgacccatccaatttcttcaagaacgaacaatccattccatccttgaaaccatggtggaacaagagaggttattggtcacatccacaatttgaaaag

SEQ ID NO: 135 - protein, 619 aa, Artificial Sequence
  Synthetic Construct
MRFPSIFTAVLFAASSALAAPVNTTTEDETAQIPAEAVIGYSDLEGDFDVAVLPFSNSTNNGLLFINTTIASIAAKEEGVSLEKREAEAMAHNHESFLHCLSHHSPNTSSISKIIYTPTNPSYSSVLNFSIHNLRFTSPKTPKPHIIVTPFLVSQIQASIICAKKTGFQIRTRSGGHDYEGLSYVSDVSFVVVDLINLRSISVDAENNVAWVQSGATIGELYYRIAEKSKTLGFPAGVCPTVGVGGHFSGGGYGLMLRKFGLAADNVIDAYFIDVNGKLHDRKSMGEDVFWAIRGGGGASFGIVLAWKIKLLPVPSIVTVFTITRTLEQNATDLIHRWQYVSSKQDDKLFIRIILTGINTTNSQHGNKRTIEAAFNSLFLGKIEELVPIMEKTFPELGLTKEDCIEMSWIESVLYFAGFSRGQPLNVLLDRRPLTPKRFFKAKSDYVNEPIPKAGLEGIWELFDEEEAEAAVLILSPYGGIMDKISESEIPFPHRAGNLYKIQHLVYWDEEGEDIAKRHINWIRKLYSYMAPFVSKNPRAAYINYRDLDIGTNEKNGRNTSYNEASVWGVKYFKGNFKRLVSVKTKVDPSNFFKNEQSIPSLKPWWNKRGYWSHPQFEK

What is claimed is:

1. A method for producing one or more cannabinoids, the method comprising contacting cannabigerolic acid (CBGA) with a cannabinoid synthase orthologue, wherein the orthologue includes an amino acid sequence selected from the group consisting of SEQ ID NOs: 16, 23, 47, 57, 87, 107 and 117 and wherein the cannabinoids produced have a molecular weight of 358.5 g/mol, 374.5 g/mol, or 330.5 g/mol.

2. The method of claim 1, wherein the cannabinoids produced include cannabielsoic acid and cannabielsoin.

3. The method of claim 1, wherein the cannabinoid synthase orthologue is a recombinant enzyme produced in *Saccharomyces cerevisiae*, *Yarrowia lipolytica*, *Kluyveromyces marxianus*, or *Pichia pastoris*.

* * * * *